United States Patent 8,163,896 (BIOINFORMATICALLY DETECTABLE GROUP OF NOVEL REGULATORY GENES AND USES THEREOF) - sequence listing, part 2

SEQ ID NO: 4859 - DNA, 32 bp, Homo sapiens
tgaggaaatgagatcacatctttgtcactgga

SEQ ID NO: 4860 - DNA, 24 bp, Homo sapiens
tcatgcctgtattcccaccacttt

SEQ ID NO: 4861 - DNA, 32 bp, Homo sapiens
tgttttgtatttctctggagtgcaatggtgca

SEQ ID NO: 4862 - DNA, 26 bp, Homo sapiens
ctgtgttgtccaggctggagtgcagt

SEQ ID NO: 4863 - DNA, 19 bp, Homo sapiens
tgtgggaaaggaatgtgga

SEQ ID NO: 4864 - DNA, 32 bp, Homo sapiens
catttgttgctgctgctgctcattccacactg

SEQ ID NO: 4865 - DNA, 32 bp, Homo sapiens
agccctccctggtccccataggcacagttggg

SEQ ID NO: 4866 - DNA, 32 bp, Homo sapiens
aatgtggccttatttggagacagggtcttcac

SEQ ID NO: 4867 - DNA, 24 bp, Homo sapiens
tggtgcaacctcagctcactgcag

SEQ ID NO: 4868 - DNA, 24 bp, Homo sapiens
tggcacaatcttgactcgctgcag

SEQ ID NO: 4869 - DNA, 32 bp, Homo sapiens
acagatgtgctgctgttcccaggccacctgca

SEQ ID NO: 4870 - DNA, 32 bp, Homo sapiens
cttctgtcgcccaggctggagtgcagtggcgc

SEQ ID NO: 4871 - DNA, 32 bp, Homo sapiens
gctaatcctcatctgtcatatccagaaatcac

SEQ ID NO: 4872 - DNA, 32 bp, Homo sapiens
gctgaaaatccttttgccagctaattgtgaga

SEQ ID NO: 4873 - DNA, 32 bp, Homo sapiens
ctcttgttgtctaggctggagtgccgtggtgc

SEQ ID NO: 4874 - DNA, 32 bp, Homo sapiens
gctctattgcccaggctggagtgcagtggtac

SEQ ID NO: 4875 - DNA, 32 bp, Homo sapiens
gccctgtcacccaggctggagtgcagtggtgt

SEQ ID NO: 4876 - DNA, 32 bp, Homo sapiens
tctcagtcacttcagtatctttgctacacaga

SEQ ID NO: 4877 - DNA, 32 bp, Homo sapiens
ctggaagaacaacagggaagacatccatcatt

SEQ ID NO: 4878 - DNA, 32 bp, Homo sapiens
cccctgatgcccaggctgggtgcaggctctca

SEQ ID NO: 4879 - DNA, 32 bp, Homo sapiens
agaggttgcagtgagccgagatcatgtcactg

SEQ ID NO: 4880 - DNA, 32 bp, Homo sapiens
ctactcgggaggctgaggcaggagaatggtgt

SEQ ID NO: 4881 - DNA, 32 bp, Homo sapiens
cagcgcgggaggcggcgaagggcgcaggagca

SEQ ID NO: 4882 - DNA, 32 bp, Homo sapiens
acctctgcctcctgggttcaagcgattctcct

SEQ ID NO: 4883 - DNA, 32 bp, Homo sapiens
ccaacctcctcctgggttccagcgattctcct

SEQ ID NO: 4884 - DNA, 28 bp, Homo sapiens
tccatctcacgcgctgcctctgtcattt

SEQ ID NO: 4885 - DNA, 32 bp, Homo sapiens
gtcccagagaaaagcaggctgtggaaaactgg

SEQ ID NO: 4886 - DNA, 32 bp, Homo sapiens
gattctcccagagattgcctggaacaccagct

SEQ ID NO: 4887 - DNA, 32 bp, Homo sapiens
acctccgcatcccgggttcaagcgattctcct

SEQ ID NO: 4888 - DNA, 32 bp, Homo sapiens
aggctcccgagtagctgggattacaggcatgt

SEQ ID NO: 4889 - DNA, 32 bp, Homo sapiens
agcttcctgagtagctgggactacaggcaccc

SEQ ID NO: 4890 - DNA, 32 bp, Homo sapiens
gtgggaatgaattggcattgcaggaaagacag

SEQ ID NO: 4891 - DNA, 32 bp, Homo sapiens
ccaggttcaagcaattctcctgtctcagcctc

SEQ ID NO: 4892 - DNA, 32 bp, Homo sapiens
gttagctccctgcactctggctctttactggc

SEQ ID NO: 4893 - DNA, 32 bp, Homo sapiens
tgtcacaggcctggactaaattgattttacgt

SEQ ID NO: 4894 - DNA, 32 bp, Homo sapiens
gagatgagaagaggcacaagaaacaatctcga

SEQ ID NO: 4895 - DNA, 32 bp, Homo sapiens
cctagaaactgaggggctatggtgctaagcag

SEQ ID NO: 4896 - DNA, 32 bp, Homo sapiens
ctaggctcaagcaatcctcccatcttagcctc

SEQ ID NO: 4897 - DNA, 32 bp, Homo sapiens
taactgcatcttctccccttgccaccccatgg

SEQ ID NO: 4898 - DNA, 32 bp, Homo sapiens
tgccaacatcttcatcacagttggctgttagg

SEQ ID NO: 4899 - DNA, 23 bp, Homo sapiens
tcacacctgtaatcccgcacttt

SEQ ID NO: 4900 - DNA, 32 bp, Homo sapiens
tcgtagctccccattgaacacaggtgtcatca

SEQ ID NO: 4901 - DNA, 22 bp, Homo sapiens
ctggagaagtaggcctggagtt

SEQ ID NO: 4902 - DNA, 23 bp, Homo sapiens
ctggagaagctacagcctggtca

SEQ ID NO: 4903 - DNA, 32 bp, Homo sapiens
gagcctgggatgtcaaggctgcagtgagctgt

SEQ ID NO: 4904 - DNA, 32 bp, Homo sapiens
ctcctcagatatacttggttctctccaccagg

SEQ ID NO: 4905 - DNA, 32 bp, Homo sapiens
ttgagatggagtttggttctgtccccgaggcc

SEQ ID NO: 4906 - DNA, 28 bp, Homo sapiens
caggccaccagtgctgcctcagggtgtc

SEQ ID NO: 4907 - DNA, 32 bp, Homo sapiens
tgttccccaagtgtacttaatcaccttagtgc

SEQ ID NO: 4908 - DNA, 32 bp, Homo sapiens
gaacctgggaggcagaggttgcagtgaggtga

SEQ ID NO: 4909 - DNA, 32 bp, Homo sapiens
gtgtctggaacacgctgctcccctgggcagct

SEQ ID NO: 4910 - DNA, 32 bp, Homo sapiens
gacatcagggcaggcttcctggagcaggaggt

SEQ ID NO: 4911 - DNA, 32 bp, Homo sapiens
gcctcctgaagtagctggaactacagacatgc

SEQ ID NO: 4912 - DNA, 32 bp, Homo sapiens
agcctgtcaagtagctgggattacaggcgtgt

SEQ ID NO: 4913 - DNA, 32 bp, Homo sapiens
ctttaaggtccacctgcgcccactgagctgga

SEQ ID NO: 4914 - DNA, 32 bp, Homo sapiens
agagaaacagagacagaaagaaagagacagac

SEQ ID NO: 4915 - DNA, 32 bp, Homo sapiens
aggtcgagggtagataggccttaacttagtcc

SEQ ID NO: 4916 - DNA, 32 bp, Homo sapiens
agcctcccaaagtggtgggattataggcatga

SEQ ID NO: 4917 - DNA, 32 bp, Homo sapiens
atgatctctgcagcatttttcttggaacctct

SEQ ID NO: 4918 - DNA, 32 bp, Homo sapiens
atgtgcacccttctccctccagcctgggctac

SEQ ID NO: 4919 - DNA, 32 bp, Homo sapiens
ggaggagagagaggagaagggaggcaagggag

SEQ ID NO: 4920 - DNA, 32 bp, Homo sapiens
taagccaaagccatgtggaatttttgtttaga

SEQ ID NO: 4921 - DNA, 32 bp, Homo sapiens
cactcccctaacccatagcacaggctgagtcc

SEQ ID NO: 4922 - DNA, 32 bp, Homo sapiens
cctgcccccaaaatattttcatctttccccca

SEQ ID NO: 4923 - DNA, 32 bp, Homo sapiens
aggaaggcagaactatccgctgaggaacctgg

SEQ ID NO: 4924 - DNA, 32 bp, Homo sapiens
ggggcgtggagttttgtcttgtattttggcct

SEQ ID NO: 4925 - DNA, 32 bp, Homo sapiens
ccgacagctctgaagatgaattttgattggac

SEQ ID NO: 4926 - DNA, 32 bp, Homo sapiens
actctgtcacccaggctgggatgcagtggctt

SEQ ID NO: 4927 - DNA, 32 bp, Homo sapiens
atgttaaattggcttgaaattttcagagaatt

SEQ ID NO: 4928 - DNA, 32 bp, Homo sapiens
ttgtgcccatgggctgtggcgtatgtcagatc

SEQ ID NO: 4929 - DNA, 32 bp, Homo sapiens
gattcctgcccaggggagagaggcgctgggaa

SEQ ID NO: 4930 - DNA, 32 bp, Homo sapiens
catatcagatgctcaaggctggcagctacccc

SEQ ID NO: 4931 - DNA, 32 bp, Homo sapiens
cacaggacgaagaaggcttcaaaaagtcccaa

SEQ ID NO: 4932 - DNA, 32 bp, Homo sapiens
ctccgatcaaagccggccgtgctgctggccgg

SEQ ID NO: 4933 - DNA, 32 bp, Homo sapiens
ttatattgcctaggctggaatgcagtggttat

SEQ ID NO: 4934 - DNA, 32 bp, Homo sapiens
aaaagctcagggcggtcgagtgcagtggctcg

SEQ ID NO: 4935 - DNA, 32 bp, Homo sapiens
gtctccaactcctgggctcaagcaatcctcct

SEQ ID NO: 4936 - DNA, 28 bp, Homo sapiens
caggatcaatgtggtgcctcatccaggg

SEQ ID NO: 4937 - DNA, 32 bp, Homo sapiens
gaagccgggaggtgggggttgcagtgagccga

SEQ ID NO: 4938 - DNA, 23 bp, Homo sapiens
tcatgcctgtaatcccaacactt

SEQ ID NO: 4939 - DNA, 32 bp, Homo sapiens
ctggtctcaagccattctcccacctctgtcct

SEQ ID NO: 4940 - DNA, 32 bp, Homo sapiens
ggctcatgcctgtaatcgtagcactttgagag

SEQ ID NO: 4941 - DNA, 32 bp, Homo sapiens
ttcctccaatgtgctttcacagcttcacttcc

SEQ ID NO: 4942 - DNA, 32 bp, Homo sapiens
gcagagaggctgagaccaacccagaaaccacc

SEQ ID NO: 4943 - DNA, 32 bp, Homo sapiens
caccccactggccttctcaggtgcaatcagta

SEQ ID NO: 4944 - DNA, 24 bp, Homo sapiens
ctgaccaacatggtgaaacgctat

SEQ ID NO: 4945 - DNA, 24 bp, Homo sapiens
catcccccacagggtccctgataa

SEQ ID NO: 4946 - DNA, 17 bp, Homo sapiens
caggggagctcccagcc

SEQ ID NO: 4947 - DNA, 32 bp, Homo sapiens
ggacaagggaggcagtggctagtggggtgaac

SEQ ID NO: 4948 - DNA, 32 bp, Homo sapiens
tgaactttaaatcaatcagtgctgctggcaca

SEQ ID NO: 4949 - DNA, 32 bp, Homo sapiens
ttctgtcacccaggctggagtgcagtggcacc

SEQ ID NO: 4950 - DNA, 32 bp, Homo sapiens
agtgtttgcctatgtggaaacaacagcaaact

SEQ ID NO: 4951 - DNA, 32 bp, Homo sapiens
cctgccaccggtgcccttcaccaagcttccca

SEQ ID NO: 4952 - DNA, 32 bp, Homo sapiens
ctactcgggaggctgagacaggagaattgctt

SEQ ID NO: 4953 - DNA, 32 bp, Homo sapiens
agcctcccacagtgctgggattagaggcatga

SEQ ID NO: 4954 - DNA, 32 bp, Homo sapiens
gatggacagtatcagtcttgatctaaattgta

SEQ ID NO: 4955 - DNA, 32 bp, Homo sapiens
tccaggatatgtgtcatttcccatgaggggcc

SEQ ID NO: 4956 - DNA, 32 bp, Homo sapiens
taggcagaaagaggaggacaaagaggaggaaa

SEQ ID NO: 4957 - DNA, 32 bp, Homo sapiens
ccatgttcaagcaattctcctgcctcagcctc

SEQ ID NO: 4958 - DNA, 32 bp, Homo sapiens
ggctcactcctgtaattccagcactttgggag

SEQ ID NO: 4959 - DNA, 32 bp, Homo sapiens
gtctgttttcttacctgcaaatggcaggtact

SEQ ID NO: 4960 - DNA, 31 bp, Homo sapiens
ttgaaggggacacagtctaggagggggataa

SEQ ID NO: 4961 - DNA, 32 bp, Homo sapiens
tgtcgaggaagggaagaaagaaacagaagtca

SEQ ID NO: 4962 - DNA, 32 bp, Homo sapiens
cactgtcagatttccactcttctgcctttagg

SEQ ID NO: 4963 - DNA, 32 bp, Homo sapiens
actgggcctgcagctcccttctcctgggactt

SEQ ID NO: 4964 - DNA, 32 bp, Homo sapiens
catcatgcatcactctcccttctgcctccttc

SEQ ID NO: 4965 - DNA, 32 bp, Homo sapiens
ctgtgttgcccaggctggagtgcagtagtgca

SEQ ID NO: 4966 - DNA, 32 bp, Homo sapiens
gcgtggtcacggggagcttcctgggcaagcaa

SEQ ID NO: 4967 - DNA, 32 bp, Homo sapiens
ccctgggctcccatctcttcagtctagaggcg

SEQ ID NO: 4968 - DNA, 24 bp, Homo sapiens
ccaccactgccccaccacccagag

SEQ ID NO: 4969 - DNA, 21 bp, Homo sapiens
caccagctttcagccaccatg

SEQ ID NO: 4970 - DNA, 32 bp, Homo sapiens
gagctggaatcctctttcaggtaccaaatgtc

SEQ ID NO: 4971 - DNA, 32 bp, Homo sapiens
tctctgtcacccaggctggagtgcagtggcgt

SEQ ID NO: 4972 - DNA, 32 bp, Homo sapiens
ttaagatggagtttccctctgttgccaggcta

SEQ ID NO: 4973 - DNA, 32 bp, Homo sapiens
ggataagcagctcagtcacaggcagaagaagg

SEQ ID NO: 4974 - DNA, 32 bp, Homo sapiens
ctctgtcaccgaggttggagtgcagtggtatg

SEQ ID NO: 4975 - DNA, 32 bp, Homo sapiens
tgctgctgcccaggctggagtgcagtggtgca

SEQ ID NO: 4976 - DNA, 32 bp, Homo sapiens
ctgcctccctcctttccatcttggtgtcttcc

SEQ ID NO: 4977 - DNA, 32 bp, Homo sapiens
gaacctgagaggcagaggttgcagtgagccga

SEQ ID NO: 4978 - DNA, 32 bp, Homo sapiens
ccccaggagaggcagagagtgagggaaagggc

SEQ ID NO: 4979 - DNA, 32 bp, Homo sapiens
ctctgttgcccaggctggagtgcagtggtgag

SEQ ID NO: 4980 - DNA, 28 bp, Homo sapiens
ttatttcaggttcatgcctcattacaca

SEQ ID NO: 4981 - DNA, 32 bp, Homo sapiens
ttttctcaacccaagtcaaacaacagtttgtg

SEQ ID NO: 4982 - DNA, 32 bp, Homo sapiens
gaacctgggagacagaggttgcaatgaaccga

SEQ ID NO: 4983 - DNA, 32 bp, Homo sapiens
acctccacctctcagattcaagcaattctcct

SEQ ID NO: 4984 - DNA, 32 bp, Homo sapiens
acccccacctcccaggttcaagcgattctcct

SEQ ID NO: 4985 - DNA, 28 bp, Homo sapiens
tccctccttcttgctgcctcctcctcct

SEQ ID NO: 4986 - DNA, 32 bp, Homo sapiens
agcttcccaagtagctgggattacaggcaccc

SEQ ID NO: 4987 - DNA, 32 bp, Homo sapiens
gaacagcaggaggttttcctggacaccgccaa

SEQ ID NO: 4988 - DNA, 32 bp, Homo sapiens
ctggctctgagtcgctctcccacccagcctgg

SEQ ID NO: 4989 - DNA, 32 bp, Homo sapiens
acttctgctttgcactatgttcactttggggt

SEQ ID NO: 4990 - DNA, 32 bp, Homo sapiens
tcagcctcgagtagctgggactacaggcgcat

SEQ ID NO: 4991 - DNA, 32 bp, Homo sapiens
gtctggcaggtgggggaatgagatgagaaagt

SEQ ID NO: 4992 - DNA, 32 bp, Homo sapiens
ccgggttcaagcatttctcctgtctcagcctc

SEQ ID NO: 4993 - DNA, 32 bp, Homo sapiens
ctgggctcaagcaatcctcccaccttggcctc

SEQ ID NO: 4994 - DNA, 22 bp, Homo sapiens
tcatgctggccggcgtggcccc

SEQ ID NO: 4995 - DNA, 32 bp, Homo sapiens
tgaggaggaggaggagaagcggatgagatcgt

SEQ ID NO: 4996 - DNA, 32 bp, Homo sapiens
agttggcagagaatggaaagaaagcaatggtc

SEQ ID NO: 4997 - DNA, 32 bp, Homo sapiens
gggagttcagctgcttctcttgcctaagtatt

SEQ ID NO: 4998 - DNA, 18 bp, Homo sapiens
gtggggagccgatgggga

SEQ ID NO: 4999 - DNA, 32 bp, Homo sapiens
tgacgccttctgggccccatctgtccttcctc

SEQ ID NO: 5000 - DNA, 18 bp, Homo sapiens
gccatcaaatgcccagga

SEQ ID NO: 5001 - DNA, 21 bp, Homo sapiens
ttcatgtacatgtgtctattc

SEQ ID NO: 5002 - DNA, 32 bp, Homo sapiens
ccctcccccaaaagttataaaaccattttatc

SEQ ID NO: 5003 - DNA, 16 bp, Homo sapiens
cagggaagctccagct

SEQ ID NO: 5004 - DNA, 32 bp, Homo sapiens
ttgagatggagtttcgctctgttgtccaggct

SEQ ID NO: 5005 - DNA, 23 bp, Homo sapiens
tggcactatcccaactcactgca

SEQ ID NO: 5006 - DNA, 32 bp, Homo sapiens
gctccgtcgcccaggctggcatgcagttgcgc

SEQ ID NO: 5007 - DNA, 32 bp, Homo sapiens
gaaatcccagttcatgttgctcagaagagaat

SEQ ID NO: 5008 - DNA, 32 bp, Homo sapiens
atgacctctttccttgttttgttttcatgctg

SEQ ID NO: 5009 - DNA, 32 bp, Homo sapiens
ggagtgatgaacgggctggagcagtctgagga

SEQ ID NO: 5010 - DNA, 32 bp, Homo sapiens
gctctgttgcctaggctggagtacagtggtgc

SEQ ID NO: 5011 - DNA, 32 bp, Homo sapiens
ggtcccagctccaggctggagccagtgaaggg

SEQ ID NO: 5012 - DNA, 32 bp, Homo sapiens
gagaccgtgtccatggggcgtgcagtggaggc

SEQ ID NO: 5013 - DNA, 32 bp, Homo sapiens
aactctgaacaacccacggcagcttctagccc

SEQ ID NO: 5014 - DNA, 32 bp, Homo sapiens
ctgctatttcccaagctggagtgcagtggtgc

SEQ ID NO: 5015 - DNA, 32 bp, Homo sapiens
gaaccctagaggcggagtttgcagtgagccga

SEQ ID NO: 5016 - DNA, 32 bp, Homo sapiens
ctctgtcgtcgaggctggagtgtagtggtgcg

SEQ ID NO: 5017 - DNA, 22 bp, Homo sapiens
gctcggaccttccgctctcccc

SEQ ID NO: 5018 - DNA, 32 bp, Homo sapiens
gaacctgggagacggaggttgcagtgagccat

SEQ ID NO: 5019 - DNA, 32 bp, Homo sapiens
aaacctgggagtttgaagctgcagtgagccat

SEQ ID NO: 5020 - DNA, 32 bp, Homo sapiens
taccaggggaggcagtgtctggatgatgctgt

SEQ ID NO: 5021 - DNA, 32 bp, Homo sapiens
ctggcttcaagcagtcctcctgcctcagcctc

SEQ ID NO: 5022 - DNA, 32 bp, Homo sapiens
ggaacctggatattgagctcttacttttctcc

SEQ ID NO: 5023 - DNA, 32 bp, Homo sapiens
ggatgccatacaacaggactatgtgatggttt

SEQ ID NO: 5024 - DNA, 17 bp, Homo sapiens
cccctgctcttccaggt

SEQ ID NO: 5025 - DNA, 32 bp, Homo sapiens
aactgtagaagagaatcaagaagaaaaataaa

SEQ ID NO: 5026 - DNA, 32 bp, Homo sapiens
actttatcacccagactggcgtgcagtggcac

SEQ ID NO: 5027 - DNA, 32 bp, Homo sapiens
cctatccagaatgcatctcttctgcttcccat

SEQ ID NO: 5028 - DNA, 32 bp, Homo sapiens
ttagaaaacatgttccccatctggtgctctta

SEQ ID NO: 5029 - DNA, 32 bp, Homo sapiens
gagaagctatgtttagcatcttctgtcatgag

SEQ ID NO: 5030 - DNA, 32 bp, Homo sapiens
tcagatgcccctgagaccacccagaaatcaag

SEQ ID NO: 5031 - DNA, 32 bp, Homo sapiens
ccgtgtcatccaggctggagtgcggtggtgga

SEQ ID NO: 5032 - DNA, 32 bp, Homo sapiens
ccctgcagttcccagtctcttctgtcctgcag

SEQ ID NO: 5033 - DNA, 32 bp, Homo sapiens
tgggccttgctgctgctgcacccaactactga

SEQ ID NO: 5034 - DNA, 32 bp, Homo sapiens
tctctggtgctgcttctgtatatttccacagc

SEQ ID NO: 5035 - DNA, 32 bp, Homo sapiens
tttcaactcctctcttcttaacactatgaagt

SEQ ID NO: 5036 - DNA, 32 bp, Homo sapiens
ccctactgcccaggctggaatccaagagtggg

SEQ ID NO: 5037 - DNA, 32 bp, Homo sapiens
aaggtggccatggatggatgggctgtatctgt

SEQ ID NO: 5038 - DNA, 19 bp, Homo sapiens
tcaaccatggcctgggcat

SEQ ID NO: 5039 - DNA, 32 bp, Homo sapiens
gaacccgggaggcggaacttgcggtgagccga

SEQ ID NO: 5040 - DNA, 32 bp, Homo sapiens
ctgtgttgcccaggctggagtgcggtggctat

SEQ ID NO: 5041 - DNA, 32 bp, Homo sapiens
ctctgtcacccagtttggagtgcagtggtgca

SEQ ID NO: 5042 - DNA, 32 bp, Homo sapiens
gaactggggaagcagaggttgtagtgagccga

SEQ ID NO: 5043 - DNA, 32 bp, Homo sapiens
aaacccgggaggcggagcttgcagtgagccaa

SEQ ID NO: 5044 - DNA, 32 bp, Homo sapiens
ataacagggaggcagaattcaggttggcttga

SEQ ID NO: 5045 - DNA, 32 bp, Homo sapiens
actgccgcctcccgggttcaagcaattctcat

SEQ ID NO: 5046 - DNA, 32 bp, Homo sapiens
gaacccgggaggcggaacttgcagtgagccaa

SEQ ID NO: 5047 - DNA, 32 bp, Homo sapiens
gagcccaggaggtggaggttgcactgagcgga

SEQ ID NO: 5048 - DNA, 32 bp, Homo sapiens
agcaactcggaagaggaaagaaaggaagtcag

SEQ ID NO: 5049 - DNA, 32 bp, Homo sapiens
gctcctccccttctttctcttccttctgcctc

SEQ ID NO: 5050 - DNA, 24 bp, Homo sapiens
tcatgcttgtaatcctagcacttt

SEQ ID NO: 5051 - DNA, 32 bp, Homo sapiens
gctttcttggaagaagaaagaaacaaaaactg

SEQ ID NO: 5052 - DNA, 32 bp, Homo sapiens
cttctgtggtcaggctgggacagtgaaaggca

SEQ ID NO: 5053 - DNA, 32 bp, Homo sapiens
cgctgtcacccaggctggagtgcagtgctgcg

SEQ ID NO: 5054 - DNA, 32 bp, Homo sapiens
gcctcaacctggacctgacaccaacttcgccg

SEQ ID NO: 5055 - DNA, 32 bp, Homo sapiens
ggagctagggctgctgcctcagctccaagaca

SEQ ID NO: 5056 - DNA, 32 bp, Homo sapiens
cattgccaacctcactgacacagggtcatagt

SEQ ID NO: 5057 - DNA, 32 bp, Homo sapiens
gggaagcccgtggcagggcacagggttgtccc

SEQ ID NO: 5058 - DNA, 32 bp, Homo sapiens
aaggacggacgggagctccactgtgaatcggc

SEQ ID NO: 5059 - DNA, 18 bp, Homo sapiens
cagggaagcgtgcagccc

SEQ ID NO: 5060 - DNA, 23 bp, Homo sapiens
tgacgtgatctccgctcactgca

SEQ ID NO: 5061 - DNA, 32 bp, Homo sapiens
catgaatgtacaagtttagcaaacttcctcct

SEQ ID NO: 5062 - DNA, 32 bp, Homo sapiens
aatcggaaaatgaggcttatcctccagcagaa

SEQ ID NO: 5063 - DNA, 32 bp, Homo sapiens
ctgagaatcagcacacaccatatttcaaatat

SEQ ID NO: 5064 - DNA, 32 bp, Homo sapiens
tgtcacccaggctgctggagtacagtggcaca

SEQ ID NO: 5065 - DNA, 32 bp, Homo sapiens
tcttgttgcccaggttggagtgtaatagcacg

SEQ ID NO: 5066 - DNA, 32 bp, Homo sapiens
ctgtcgtccaggctggagtgcagtacgcaatc

SEQ ID NO: 5067 - DNA, 32 bp, Homo sapiens
caacccaggaggcagaggctacagtgagctga

SEQ ID NO: 5068 - DNA, 32 bp, Homo sapiens
ggaatttcaaaccattgctcttagtcccaagc

SEQ ID NO: 5069 - DNA, 32 bp, Homo sapiens
ctctgttgcccaggctggagtaaagggcagtg

SEQ ID NO: 5070 - DNA, 32 bp, Homo sapiens
gaacctgggaagtggaggctgcagtgagccga

SEQ ID NO: 5071 - DNA, 32 bp, Homo sapiens
gaaccagggagtcggagattgcagtgagctga

SEQ ID NO: 5072 - DNA, 32 bp, Homo sapiens
gaatccctgaggcagaggttgcagtgagctga

SEQ ID NO: 5073 - DNA, 32 bp, Homo sapiens
ttttcagcagtaacaggaaaccacttatcaca

SEQ ID NO: 5074 - DNA, 32 bp, Homo sapiens
gattgtgtcaaatgattcctggaatcctttac

SEQ ID NO: 5075 - DNA, 32 bp, Homo sapiens
gccctgtcacccaggctggggtacggtggcat

SEQ ID NO: 5076 - DNA, 32 bp, Homo sapiens
ggcctcctgagtacctgggattataggcacaa

SEQ ID NO: 5077 - DNA, 32 bp, Homo sapiens
cagcatcctggtagctgggactacaagtgtga

SEQ ID NO: 5078 - DNA, 31 bp, Homo sapiens
cctgccgcacagcccagcaggagggaggcgg

SEQ ID NO: 5079 - DNA, 32 bp, Homo sapiens
ggccagagaggaggagaaggagggtgagagga

SEQ ID NO: 5080 - DNA, 32 bp, Homo sapiens
agatagtcaagcatttagaagtgcagtgaact

SEQ ID NO: 5081 - DNA, 32 bp, Homo sapiens
cagcccggggacagagcaagacactgtctcaa

SEQ ID NO: 5082 - DNA, 32 bp, Homo sapiens
gcccagctgggctgcctcaggtgtcaggaagg

SEQ ID NO: 5083 - DNA, 32 bp, Homo sapiens
tgttggatgtgtatagtgtctttgccatttta

SEQ ID NO: 5084 - DNA, 32 bp, Homo sapiens
tagctccatattggacatccccagaaaagatg

SEQ ID NO: 5085 - DNA, 32 bp, Homo sapiens
agaaatgccagacctgtatcccagaaaataaa

SEQ ID NO: 5086 - DNA, 32 bp, Homo sapiens
ctctttgaagttaatatttttctgccttctaa

SEQ ID NO: 5087 - DNA, 32 bp, Homo sapiens
agtgccattcctgtccttaaggcacagtctca

SEQ ID NO: 5088 - DNA, 18 bp, Homo sapiens
gcagtcaccatgctctcc

SEQ ID NO: 5089 - DNA, 32 bp, Homo sapiens
accccggcttcctggggacacagggttggcac

SEQ ID NO: 5090 - DNA, 32 bp, Homo sapiens
tataatggaagaggctttctctctccaataaa

SEQ ID NO: 5091 - DNA, 32 bp, Homo sapiens
gtagatgagccttttagtagagctgatttatt

SEQ ID NO: 5092 - DNA, 32 bp, Homo sapiens
cacgtggtggcatcctgacaggcacagtgaga

SEQ ID NO: 5093 - DNA, 32 bp, Homo sapiens
aagcccgggaggtggaggttgcagtgagccca

SEQ ID NO: 5094 - DNA, 32 bp, Homo sapiens
cccgcctgctaagctgtgtgtgcagtgatggc

SEQ ID NO: 5095 - DNA, 32 bp, Homo sapiens
gggagccaaggtgacacttcactgtgaagccc

SEQ ID NO: 5096 - DNA, 32 bp, Homo sapiens
gaagctcggactcagtctgatctagctgagct

SEQ ID NO: 5097 - DNA, 32 bp, Homo sapiens
taccataggtcaaaaggactggaattttcctt

SEQ ID NO: 5098 - DNA, 32 bp, Homo sapiens
tatttttctgttagctgggtttacatgtgatg

SEQ ID NO: 5099 - DNA, 32 bp, Homo sapiens
agcctcccaagtagctgggattacagcgattg

SEQ ID NO: 5100 - DNA, 32 bp, Homo sapiens
agggggaaagaaggagaaaggaaagaaaaacc

SEQ ID NO: 5101 - DNA, 32 bp, Homo sapiens
ctgggctcaacggatccttccacctcagcctc

SEQ ID NO: 5102 - DNA, 32 bp, Homo sapiens
atactacaattgcacttccagcactttgagaa

SEQ ID NO: 5103 - DNA, 32 bp, Homo sapiens
ctcaggaatcttctccccagagactcctaagt

SEQ ID NO: 5104 - DNA, 32 bp, Homo sapiens
acctgggtctggggtctcaggcgcaaactgga

SEQ ID NO: 5105 - DNA, 32 bp, Homo sapiens
ggactctggagaggagattgaaatataattgc

SEQ ID NO: 5106 - DNA, 32 bp, Homo sapiens
ttttgagataatttcactcttgttgcccaggc

SEQ ID NO: 5107 - DNA, 32 bp, Homo sapiens
ccttgtcctcaagatttttagtttggcccaag

SEQ ID NO: 5108 - DNA, 32 bp, Homo sapiens
atttttgttttgttcactcttctgccttcagt

SEQ ID NO: 5109 - DNA, 32 bp, Homo sapiens
gaaccctggaggcagaggttgtagtgagtcgt

SEQ ID NO: 5110 - DNA, 32 bp, Homo sapiens
tttcaggccaacatggccgtgctgctgctgct

SEQ ID NO: 5111 - DNA, 32 bp, Homo sapiens
tggatggagcccaggcgggagcggtggccctg

SEQ ID NO: 5112 - DNA, 32 bp, Homo sapiens
caggacacttcctgtgtgcctgcagttgtcag

SEQ ID NO: 5113 - DNA, 28 bp, Homo sapiens
agcagcccaagtgtcatcccattcaccc

SEQ ID NO: 5114 - DNA, 32 bp, Homo sapiens
cactttgggaggcagaggtgggaggattgctt

SEQ ID NO: 5115 - DNA, 32 bp, Homo sapiens
agcctccctagtagctgggactttaagtgtac

SEQ ID NO: 5116 - DNA, 32 bp, Homo sapiens
accctcccaaagtgctgggattataggcatga

SEQ ID NO: 5117 - DNA, 32 bp, Homo sapiens
aaactgagaggctacttcctggggccacacag

SEQ ID NO: 5118 - DNA, 32 bp, Homo sapiens
agccttccgagtagctgggaccacaggcatgc

SEQ ID NO: 5119 - DNA, 32 bp, Homo sapiens
agcctcctgagtagctgggactacaggaatta

SEQ ID NO: 5120 - DNA, 32 bp, Homo sapiens
agcctcctgagtagctgggactacaggcatgt

SEQ ID NO: 5121 - DNA, 32 bp, Homo sapiens
gctctgtcacctgagctctagtgcagtagtgc

SEQ ID NO: 5122 - DNA, 32 bp, Homo sapiens
agtctgcctcccagactggctactgtatgtaa

SEQ ID NO: 5123 - DNA, 32 bp, Homo sapiens
ctgggctcaagcgatcctcccacctcagcctc

SEQ ID NO: 5124 - DNA, 32 bp, Homo sapiens
ggaaggggaagaggaaagcaaaggcgtcagga

SEQ ID NO: 5125 - DNA, 32 bp, Homo sapiens
aggaaggaagggagggaaagaaaggaagaaag

SEQ ID NO: 5126 - DNA, 32 bp, Homo sapiens
gctctgtcacccagactggagtgcaatggctt

SEQ ID NO: 5127 - DNA, 32 bp, Homo sapiens
ataactcagctttcaacagccatacatccaaa

SEQ ID NO: 5128 - DNA, 32 bp, Homo sapiens
ctcagtcctgcatcttttcttctgctttcttc

SEQ ID NO: 5129 - DNA, 32 bp, Homo sapiens
ccatggaatcttctcctgtgatatctgactcg

SEQ ID NO: 5130 - DNA, 32 bp, Homo sapiens
ctgatccatccctcaagccacagttaatgatt

SEQ ID NO: 5131 - DNA, 21 bp, Homo sapiens
gctgttactgatagacacctt

SEQ ID NO: 5132 - DNA, 32 bp, Homo sapiens
gtgtgttcttcataagcttcagtgcaggattt

SEQ ID NO: 5133 - DNA, 32 bp, Homo sapiens
ctggctgcagaactagacacccttgaagattt

SEQ ID NO: 5134 - DNA, 31 bp, Homo sapiens
acagccatgtcctcgtcagccggcagcggcc

SEQ ID NO: 5135 - DNA, 32 bp, Homo sapiens
gtaagtatttctatgtcaaaggcacagccttg

SEQ ID NO: 5136 - DNA, 32 bp, Homo sapiens
gccctgttccccctggaatgtgcagtgggcca

SEQ ID NO: 5137 - DNA, 32 bp, Homo sapiens
atatgaaatgttccttggcagctggactgctg

SEQ ID NO: 5138 - DNA, 32 bp, Homo sapiens
gctctgtcacccaggctggaatgcagtggcac

SEQ ID NO: 5139 - DNA, 32 bp, Homo sapiens
cttctcccaagtgggcagcagcagcagcttct

SEQ ID NO: 5140 - DNA, 32 bp, Homo sapiens
attccctcaagtgccctgaggagcatttgcaa

SEQ ID NO: 5141 - DNA, 32 bp, Homo sapiens
gaggtgggaaggcagagcatcaggagggaaca

SEQ ID NO: 5142 - DNA, 32 bp, Homo sapiens
gaccaatgagacgacttcagcatctttttaaa

SEQ ID NO: 5143 - DNA, 32 bp, Homo sapiens
ccaagcaaagcttcctgtttggaacacagaac

SEQ ID NO: 5144 - DNA, 32 bp, Homo sapiens
cttggttccagcaattcttctgcctcagcctc

SEQ ID NO: 5145 - DNA, 32 bp, Homo sapiens
agtctcctgagtagctgggatgacaggcacgc

SEQ ID NO: 5146 - DNA, 32 bp, Homo sapiens
acgggagcaatgttgccgctgtacggagagtg

SEQ ID NO: 5147 - DNA, 18 bp, Homo sapiens
gtggatgaaggatgggga

SEQ ID NO: 5148 - DNA, 17 bp, Homo sapiens
gcccctgccgtgcaggt

SEQ ID NO: 5149 - DNA, 32 bp, Homo sapiens
gcaaaggaaaggggaaaaagaaaaacgactaa

SEQ ID NO: 5150 - DNA, 32 bp, Homo sapiens
cataaggcctccattctgtccgctcagattct

SEQ ID NO: 5151 - DNA, 32 bp, Homo sapiens
gttctgtcgcccaggctggagtgcaggggcat

SEQ ID NO: 5152 - DNA, 32 bp, Homo sapiens
gcctgctacagccttgaactcatgggctcaag

SEQ ID NO: 5153 - DNA, 32 bp, Homo sapiens
ctctgttgcccaggctgggtgcagcggtgcga

SEQ ID NO: 5154 - DNA, 32 bp, Homo sapiens
aaacctgtgccaggctgaattacagtgaaatt

SEQ ID NO: 5155 - DNA, 32 bp, Homo sapiens
actgcttgcccagggtgcagtgtgagtgtgat

SEQ ID NO: 5156 - DNA, 32 bp, Homo sapiens
gccctggggaggcaggggttggtgccctgact

SEQ ID NO: 5157 - DNA, 32 bp, Homo sapiens
ctctgtcgcccaggctggagtgcagtggtgcc

SEQ ID NO: 5158 - DNA, 32 bp, Homo sapiens
ctctgtcccccaggctggagtgcagtggtgcg

SEQ ID NO: 5159 - DNA, 32 bp, Homo sapiens
cagaggagggaagaaaatttgcagtgactgaa

SEQ ID NO: 5160 - DNA, 32 bp, Homo sapiens
tgaacccaggaagcggggttgcagtgagccaa

SEQ ID NO: 5161 - DNA, 32 bp, Homo sapiens
aacagagggaggcaggtgggaattgagggtga

SEQ ID NO: 5162 - DNA, 32 bp, Homo sapiens
ccttccaactcctgggttcaagggatcgtctt

SEQ ID NO: 5163 - DNA, 32 bp, Homo sapiens
cccacctcaagtgccttattctcacagcaagc

SEQ ID NO: 5164 - DNA, 32 bp, Homo sapiens
gaaccctggaggcagaggttgtggtgagctga

SEQ ID NO: 5165 - DNA, 32 bp, Homo sapiens
ttgtaggaatccctttgagaatgtgattcctt

SEQ ID NO: 5166 - DNA, 32 bp, Homo sapiens
tcggggcctgctgggagcccttaactccccca

SEQ ID NO: 5167 - DNA, 24 bp, Homo sapiens
tcatgcttgtaatcccagcacttt

SEQ ID NO: 5168 - DNA, 25 bp, Homo sapiens
ggtgggggtcaggtggactctggga

SEQ ID NO: 5169 - DNA, 32 bp, Homo sapiens
tctggaagaagaggaagaggaaagaaaaggag

SEQ ID NO: 5170 - DNA, 32 bp, Homo sapiens
caccccatccctctccccagtcttggatacta

SEQ ID NO: 5171 - DNA, 32 bp, Homo sapiens
atctcccaacttctcccttttggaccctgccg

SEQ ID NO: 5172 - DNA, 24 bp, Homo sapiens
tcatgcctgtaatctcagcacttt

SEQ ID NO: 5173 - DNA, 32 bp, Homo sapiens
cgtggacagcagcttcccatctggcctgtccc

SEQ ID NO: 5174 - DNA, 32 bp, Homo sapiens
gaccttcatcttctgcctcaactgtaaaccac

SEQ ID NO: 5175 - DNA, 32 bp, Homo sapiens
cattttcatcttcttccatggttccacagaag

SEQ ID NO: 5176 - DNA, 32 bp, Homo sapiens
acccgagcaagaagcagctcccagagagaaag

SEQ ID NO: 5177 - DNA, 32 bp, Homo sapiens
cagctggcttgaatttctccccagaaaatggg

SEQ ID NO: 5178 - DNA, 32 bp, Homo sapiens
ttttaaatgttttcactcagatgaacaatttg

SEQ ID NO: 5179 - DNA, 19 bp, Homo sapiens
cgatcatggctcactgcag

SEQ ID NO: 5180 - DNA, 32 bp, Homo sapiens
tatctgtgtccagcggccccagctccagccca

SEQ ID NO: 5181 - DNA, 19 bp, Homo sapiens
gccatcacctaatccaaga

SEQ ID NO: 5182 - DNA, 20 bp, Homo sapiens
cagggatgggccttccagcc

SEQ ID NO: 5183 - DNA, 32 bp, Homo sapiens
ttgagatggagtttcactctttttacccaggc

SEQ ID NO: 5184 - DNA, 32 bp, Homo sapiens
tttctagagccagcagtacgtggcttcagagg

SEQ ID NO: 5185 - DNA, 32 bp, Homo sapiens
acaacccacatcctccatcctgactgcagcat

SEQ ID NO: 5186 - DNA, 32 bp, Homo sapiens
aacaacaacatagcctagtcaaacttctcagg

SEQ ID NO: 5187 - DNA, 26 bp, Homo sapiens
ctgctgttaaccatgctgtgcatgtg

SEQ ID NO: 5188 - DNA, 32 bp, Homo sapiens
gcattgccaagtgccataaccatgagcactac

SEQ ID NO: 5189 - DNA, 32 bp, Homo sapiens
cacatgggcccaggctgagtgtgagtgagcat

SEQ ID NO: 5190 - DNA, 32 bp, Homo sapiens
ccttgtcacccaggctggagtccagtggcaca

SEQ ID NO: 5191 - DNA, 32 bp, Homo sapiens
ctctgcttcccgggttcacaagcaattctcat

SEQ ID NO: 5192 - DNA, 32 bp, Homo sapiens
ggttcagtctatcacagctcccatggagttag

SEQ ID NO: 5193 - DNA, 32 bp, Homo sapiens
ctacagtgcaccacggccttggaacaccgcac

SEQ ID NO: 5194 - DNA, 32 bp, Homo sapiens
ctggattaagatgacttcctcacatagcttgg

SEQ ID NO: 5195 - DNA, 32 bp, Homo sapiens
tggcacagtaaacaaaccctgttatgctgtat

SEQ ID NO: 5196 - DNA, 32 bp, Homo sapiens
agcctcctgagtagctggattacagggcctgg

SEQ ID NO: 5197 - DNA, 32 bp, Homo sapiens
atagaagatctgcctcccctgtggaaattggg

SEQ ID NO: 5198 - DNA, 32 bp, Homo sapiens
ccgggttcaagcaatgctcccgcctcaacctc

SEQ ID NO: 5199 - DNA, 32 bp, Homo sapiens
attgcctcagccaagtctcccacctctctgct

SEQ ID NO: 5200 - DNA, 32 bp, Homo sapiens
attttgagcagcacagtccaattctttaacta

SEQ ID NO: 5201 - DNA, 32 bp, Homo sapiens
tggaaacatcttcttcctgagacctcgttgaa

SEQ ID NO: 5202 - DNA, 32 bp, Homo sapiens
ttttagttgggcagtgctcccacccaccctcc

SEQ ID NO: 5203 - DNA, 30 bp, Homo sapiens
actgtcacaagaaatatttccacctcaaaa

SEQ ID NO: 5204 - DNA, 32 bp, Homo sapiens
ttctatcgcccaggctggagtgcaatggcaca

SEQ ID NO: 5205 - DNA, 32 bp, Homo sapiens
tgtcggcttcaaggagtccagcttatcttcct

SEQ ID NO: 5206 - DNA, 24 bp, Homo sapiens
ctgttgcccaggctggagtacaat

SEQ ID NO: 5207 - DNA, 32 bp, Homo sapiens
cctctgggcaagagcacccactgtgaagtcct

SEQ ID NO: 5208 - DNA, 32 bp, Homo sapiens
ggggcacatccctcagcaggacagcaacagtc

SEQ ID NO: 5209 - DNA, 32 bp, Homo sapiens
agataggcagagaacatctccagaaatgtgtg

SEQ ID NO: 5210 - DNA, 32 bp, Homo sapiens
ctacccgggaggctgaggcaggagaatcactt

SEQ ID NO: 5211 - DNA, 32 bp, Homo sapiens
gatggtcggaggcagaggtgtttccagtgatc

SEQ ID NO: 5212 - DNA, 32 bp, Homo sapiens
tccgacgtgcagcctggcagtgcagtgagctg

SEQ ID NO: 5213 - DNA, 32 bp, Homo sapiens
cgggtcctgagcacctgcttcatgaaggaaga

SEQ ID NO: 5214 - DNA, 24 bp, Homo sapiens
ctgtcatgcagactggagtgcagt

SEQ ID NO: 5215 - DNA, 32 bp, Homo sapiens
agcctcctgagtagctgggattacagatgtgc

SEQ ID NO: 5216 - DNA, 32 bp, Homo sapiens
gtgccaacaacgtggaactgacctaaggggcc

SEQ ID NO: 5217 - DNA, 32 bp, Homo sapiens
taaagatggaaaggagaaagaagcaacctctg

SEQ ID NO: 5218 - DNA, 32 bp, Homo sapiens
aagcacatctccatctcttccacctcaggcag

SEQ ID NO: 5219 - DNA, 32 bp, Homo sapiens
tgtgccaggcactatgctaagcactttacata

SEQ ID NO: 5220 - DNA, 32 bp, Homo sapiens
agtttcagggctaacgaccacagggtctgcac

SEQ ID NO: 5221 - DNA, 32 bp, Homo sapiens
atactcaatgattgatgacaccagttttggct

SEQ ID NO: 5222 - DNA, 31 bp, Homo sapiens
gcgggagccgcacagtcgaggagggagcgcg

SEQ ID NO: 5223 - DNA, 23 bp, Homo sapiens
tggcacaatcttggctcagtgca

SEQ ID NO: 5224 - DNA, 32 bp, Homo sapiens
gtatttcatccctagagcaggtcagcctcctt

SEQ ID NO: 5225 - DNA, 32 bp, Homo sapiens
catatcatgaacccaggacaggcacagtgggg

SEQ ID NO: 5226 - DNA, 21 bp, Homo sapiens
tttatttttagggagtgggta

SEQ ID NO: 5227 - DNA, 32 bp, Homo sapiens
ggtgggtggtgcaggctggatatatcacagaa

SEQ ID NO: 5228 - DNA, 32 bp, Homo sapiens
ttgagatggagtttcgttcttgttgcccaacc

SEQ ID NO: 5229 - DNA, 32 bp, Homo sapiens
gaaccagggaggcagagtttgcagtgaatgga

SEQ ID NO: 5230 - DNA, 32 bp, Homo sapiens
tcttgttgcccaggctggagtgcaatagcgcg

SEQ ID NO: 5231 - DNA, 32 bp, Homo sapiens
ctctgtcacccaggctggagtgcaatgctgcg

SEQ ID NO: 5232 - DNA, 28 bp, Homo sapiens
ctcacctgagtgggggcctcatctacct

SEQ ID NO: 5233 - DNA, 32 bp, Homo sapiens
caactgccaagtgctatattcaaagcaggatg

SEQ ID NO: 5234 - DNA, 32 bp, Homo sapiens
gaactgaggaggtggaggttgcagtgagccga

SEQ ID NO: 5235 - DNA, 32 bp, Homo sapiens
gcttcctagttaacaacccccatgctgcctcc

SEQ ID NO: 5236 - DNA, 19 bp, Homo sapiens
cccctggcttttccgggta

SEQ ID NO: 5237 - DNA, 32 bp, Homo sapiens
aagagcgggagaggagatggagaaacagaccc

SEQ ID NO: 5238 - DNA, 32 bp, Homo sapiens
cacttgtcacccaggctggagtgcaatggtgt

SEQ ID NO: 5239 - DNA, 32 bp, Homo sapiens
cccctgcctgggaggctctcccaggggctgat

SEQ ID NO: 5240 - DNA, 32 bp, Homo sapiens
aacccactgtgggcagcatctaagccatgtcc

SEQ ID NO: 5241 - DNA, 31 bp, Homo sapiens
tcctaactacacacagggaggagggaattat

SEQ ID NO: 5242 - DNA, 32 bp, Homo sapiens
ctgtggggtgtcctgctcacggtttcatggat

SEQ ID NO: 5243 - DNA, 32 bp, Homo sapiens
caggtgtgtgcccccaccacagctctatgact

SEQ ID NO: 5244 - DNA, 32 bp, Homo sapiens
gagcctgcagaacctgtccaggcacagtggct

SEQ ID NO: 5245 - DNA, 32 bp, Homo sapiens
ggctgtgattccattccctctgctttcttgaa

SEQ ID NO: 5246 - DNA, 32 bp, Homo sapiens
ctaggtgttgaacttagttaatggaagactga

SEQ ID NO: 5247 - DNA, 32 bp, Homo sapiens
ttaatcgtcctgctgctgctgccgttccggtg

SEQ ID NO: 5248 - DNA, 32 bp, Homo sapiens
caacttttctaagtgagcttagcaatgagaag

SEQ ID NO: 5249 - DNA, 32 bp, Homo sapiens
attgccagtggggtgggcagtgcagtggggtg

SEQ ID NO: 5250 - DNA, 32 bp, Homo sapiens
ctgtcacccaggctggagtgtgcagtggcgcg

SEQ ID NO: 5251 - DNA, 32 bp, Homo sapiens
gaacctgggaggcagaggtttcagtgagccaa

SEQ ID NO: 5252 - DNA, 32 bp, Homo sapiens
ggacttgggaggcggttgttgcagtgagctgt

SEQ ID NO: 5253 - DNA, 32 bp, Homo sapiens
ctctgtgtctcaggctggagtacagtggtgca

SEQ ID NO: 5254 - DNA, 32 bp, Homo sapiens
acctccgtctcctgggttcaagtgattctcca

SEQ ID NO: 5255 - DNA, 32 bp, Homo sapiens
tttaggaccaagccccttaacaactcaggcct

SEQ ID NO: 5256 - DNA, 32 bp, Homo sapiens
gaacccgggaggcaaaggttttagtgagccga

SEQ ID NO: 5257 - DNA, 32 bp, Homo sapiens
acatctgactcctgggttcaagcagttcttcc

SEQ ID NO: 5258 - DNA, 32 bp, Homo sapiens
ttgatggatgagggagaaagacacagtcagtt

SEQ ID NO: 5259 - DNA, 32 bp, Homo sapiens
agggagaagggagaggaatgaattgaggaagt

SEQ ID NO: 5260 - DNA, 32 bp, Homo sapiens
gcttcctcagcaacaggagccggacctacaac

SEQ ID NO: 5261 - DNA, 32 bp, Homo sapiens
ggctgtgtccacatgagctaccaccttgcgtt

SEQ ID NO: 5262 - DNA, 32 bp, Homo sapiens
gtcctcactactctgtgtcttctgcttttagg

SEQ ID NO: 5263 - DNA, 32 bp, Homo sapiens
ggttggtcttgctgtctcaggtggcagaggtg

SEQ ID NO: 5264 - DNA, 19 bp, Homo sapiens
gccatactgccacccagaa

SEQ ID NO: 5265 - DNA, 21 bp, Homo sapiens
gcccaggctggagtgcaatag

SEQ ID NO: 5266 - DNA, 32 bp, Homo sapiens
tataaatagccaacactcagtgaacaaaatcc

SEQ ID NO: 5267 - DNA, 32 bp, Homo sapiens
tcgtggccagaacttgctgaggtgaaggcaca

SEQ ID NO: 5268 - DNA, 32 bp, Homo sapiens
acagagatgtgtgctctcacagctttgcaggc

SEQ ID NO: 5269 - DNA, 32 bp, Homo sapiens
caaggaagtctgctgctccccgcagctgcgga

SEQ ID NO: 5270 - DNA, 32 bp, Homo sapiens
cactctcacccaggctggagtgcagtggcaca

SEQ ID NO: 5271 - DNA, 32 bp, Homo sapiens
ctcggggctgcaggctggagtgcagtgggaca

SEQ ID NO: 5272 - DNA, 32 bp, Homo sapiens
ggaagagcctccatttcatctcatgtccattt

SEQ ID NO: 5273 - DNA, 32 bp, Homo sapiens
aaggcctggaggcaggggcagaggtgacgaca

SEQ ID NO: 5274 - DNA, 32 bp, Homo sapiens
gaggagggcaggcagagtcggtggccagtctg

SEQ ID NO: 5275 - DNA, 32 bp, Homo sapiens
tcttgttgcccaggctggagtgcaatgacacg

SEQ ID NO: 5276 - DNA, 28 bp, Homo sapiens
atcttaccaagtgccatcatccttcacc

SEQ ID NO: 5277 - DNA, 32 bp, Homo sapiens
agggtcccaagtgtccgggcccccagctaccc

SEQ ID NO: 5278 - DNA, 32 bp, Homo sapiens
caggtccactgggtgaggagagatgtgtgggc

SEQ ID NO: 5279 - DNA, 32 bp, Homo sapiens
gcctccaactcctgggttcaagggatcctccc

SEQ ID NO: 5280 - DNA, 32 bp, Homo sapiens
ccctctgcctcttgggttcaagcgattctcct

SEQ ID NO: 5281 - DNA, 28 bp, Homo sapiens
cccaatagacatgctgcctcattcaaaa

SEQ ID NO: 5282 - DNA, 32 bp, Homo sapiens
ctaccgcaggcaaaggttcccaccttactaca

SEQ ID NO: 5283 - DNA, 32 bp, Homo sapiens
ttgggctcaagctatcctcccacctcagcctc

SEQ ID NO: 5284 - DNA, 32 bp, Homo sapiens
tttatcctgagtactgggattacaggcgccca

SEQ ID NO: 5285 - DNA, 32 bp, Homo sapiens
cggggatcaagcaactctcctgcctcagcctc

SEQ ID NO: 5286 - DNA, 32 bp, Homo sapiens
ctggcctcaagcaaccctcctgcctcagtctt

SEQ ID NO: 5287 - DNA, 32 bp, Homo sapiens
ccgggttcaagcaattcttctgcctcagcctc

SEQ ID NO: 5288 - DNA, 32 bp, Homo sapiens
ggaggaggaagaggagaggaggaagcaaagaa

SEQ ID NO: 5289 - DNA, 32 bp, Homo sapiens
gttagttcacccagttctgtggggcaggaaag

SEQ ID NO: 5290 - DNA, 32 bp, Homo sapiens
cttccatctcttacccaagtggtgctaaacaa

SEQ ID NO: 5291 - DNA, 32 bp, Homo sapiens
gacctttcaaaccagagggttgctggtcctgc

SEQ ID NO: 5292 - DNA, 32 bp, Homo sapiens
cccatctccttctggcccatctgcctgctgcc

SEQ ID NO: 5293 - DNA, 17 bp, Homo sapiens
gcccctgcattcaggtg

SEQ ID NO: 5294 - DNA, 32 bp, Homo sapiens
ttcttgaagctgggctgtctctctccatgttg

SEQ ID NO: 5295 - DNA, 32 bp, Homo sapiens
gagtcttagggacttgaaaatgtatcatgata

SEQ ID NO: 5296 - DNA, 32 bp, Homo sapiens
tgggccattgatagcatctcccaggaacaacg

SEQ ID NO: 5297 - DNA, 32 bp, Homo sapiens
gacttcaaagagaccatggttccgttggaggc

SEQ ID NO: 5298 - DNA, 32 bp, Homo sapiens
gctatgtctcccaggctggagtgcagtggcac

SEQ ID NO: 5299 - DNA, 32 bp, Homo sapiens
accctgttgcccaggctggagtgcaatggtgc

SEQ ID NO: 5300 - DNA, 32 bp, Homo sapiens
cctgactctcctgaattactagaatgtcagca

SEQ ID NO: 5301 - DNA, 32 bp, Homo sapiens
ctctgtcacccaggctggagtgcagtagcatg

SEQ ID NO: 5302 - DNA, 32 bp, Homo sapiens
ctctgtcattcaggcaagagtgcagtagtgtg

SEQ ID NO: 5303 - DNA, 32 bp, Homo sapiens
tgaacctggagacagaggttgcagtgagctga

SEQ ID NO: 5304 - DNA, 32 bp, Homo sapiens
tgatatcacccaggctggagtgcagtggcgcg

SEQ ID NO: 5305 - DNA, 32 bp, Homo sapiens
agaaatttgtcaggctgggtgcagtggctcat

SEQ ID NO: 5306 - DNA, 32 bp, Homo sapiens
gtctcaaactcctggactcaagcaatcctccc

SEQ ID NO: 5307 - DNA, 32 bp, Homo sapiens
gccaccaagaagctcctcgacaacagccactt

SEQ ID NO: 5308 - DNA, 32 bp, Homo sapiens
gctcttccctcctgggcccacaacagcgtgta

SEQ ID NO: 5309 - DNA, 32 bp, Homo sapiens
ttctcccctgcagcttcctctgcttctggaat

SEQ ID NO: 5310 - DNA, 32 bp, Homo sapiens
cacagcttttgggcttctctggcctgaatgcc

SEQ ID NO: 5311 - DNA, 32 bp, Homo sapiens
agaggtgggaggatgccttgagcttgagaggt

SEQ ID NO: 5312 - DNA, 32 bp, Homo sapiens
ggattctttctctcttctcccaacaatccaaa

SEQ ID NO: 5313 - DNA, 32 bp, Homo sapiens
tttcctggcccagcttctccttctccctctgc

SEQ ID NO: 5314 - DNA, 32 bp, Homo sapiens
agacatcaatcaggttctcttctctttcttag

SEQ ID NO: 5315 - DNA, 32 bp, Homo sapiens
actaggccagggattagccactgtgggagggt

SEQ ID NO: 5316 - DNA, 32 bp, Homo sapiens
ctggacgtgctgctgatggtacacctccaagt

SEQ ID NO: 5317 - DNA, 32 bp, Homo sapiens
ccagatcatccctcgagtccccagcgagaaag

SEQ ID NO: 5318 - DNA, 32 bp, Homo sapiens
tcgtgttgccccggctggagtgcagtggcgct

SEQ ID NO: 5319 - DNA, 32 bp, Homo sapiens
tgactgttgcccaggctggagtgtaatggcgc

SEQ ID NO: 5320 - DNA, 32 bp, Homo sapiens
actctctcgcccaggctggagtgcagtggcgt

SEQ ID NO: 5321 - DNA, 32 bp, Homo sapiens
gaacccgggaggtagagcttgcagtgaaccga

SEQ ID NO: 5322 - DNA, 32 bp, Homo sapiens
gaggccaggaggcggagcttgcagtgagccga

SEQ ID NO: 5323 - DNA, 32 bp, Homo sapiens
ctctgtcacccaggctggaatgcagtggcgtg

SEQ ID NO: 5324 - DNA, 32 bp, Homo sapiens
aacctccacctccaggttcaagcgattctcct

SEQ ID NO: 5325 - DNA, 28 bp, Homo sapiens
tccccagtgaaagctgcctcattctttt

SEQ ID NO: 5326 - DNA, 32 bp, Homo sapiens
gaaccacaaagtgccctctaataagacatcgg

SEQ ID NO: 5327 - DNA, 32 bp, Homo sapiens
ttccatcttccagagacatgaagccattatta

SEQ ID NO: 5328 - DNA, 32 bp, Homo sapiens
gagcccagggagactccgctgtgggaaacctc

SEQ ID NO: 5329 - DNA, 32 bp, Homo sapiens
tgcacaccaactccaggaaactcattctgggc

SEQ ID NO: 5330 - DNA, 18 bp, Homo sapiens
gcccagggccacccagag

SEQ ID NO: 5331 - DNA, 21 bp, Homo sapiens
ctggaaaagttgtgcctgagt

SEQ ID NO: 5332 - DNA, 32 bp, Homo sapiens
gaccagcatgttctccccaaagaccaagatat

SEQ ID NO: 5333 - DNA, 32 bp, Homo sapiens
cattctatgtagccatgtcactgtgaataacg

SEQ ID NO: 5334 - DNA, 25 bp, Homo sapiens
tggcacacgatctcggctcaccgca

SEQ ID NO: 5335 - DNA, 24 bp, Homo sapiens
acaggcatgcgtcaccacgccggc

SEQ ID NO: 5336 - DNA, 32 bp, Homo sapiens
ttctgtcacccgggctggagtgcagtggcgtg

SEQ ID NO: 5337 - DNA, 32 bp, Homo sapiens
gtaaaatctcttctgtcacacacagatgaact

SEQ ID NO: 5338 - DNA, 32 bp, Homo sapiens
tgtcccacagaacttcccactgtggatctgtg

SEQ ID NO: 5339 - DNA, 32 bp, Homo sapiens
acccccacctcccgggttcaagcgattcacct

SEQ ID NO: 5340 - DNA, 32 bp, Homo sapiens
ggccctcagaggaccaggggatcatgtctcca

SEQ ID NO: 5341 - DNA, 32 bp, Homo sapiens
ttgcctagggggcagagggtgcagtggcagtg

SEQ ID NO: 5342 - DNA, 32 bp, Homo sapiens
acctccgtctcccaggttcaagcgattctccc

SEQ ID NO: 5343 - DNA, 32 bp, Homo sapiens
acctccgcctcccaggttcaagcaattctgct

SEQ ID NO: 5344 - DNA, 32 bp, Homo sapiens
acctccgcctcccaggttcaagtaattcctct

SEQ ID NO: 5345 - DNA, 32 bp, Homo sapiens
ctgacctcaggtgatccacccacctcggcttc

SEQ ID NO: 5346 - DNA, 32 bp, Homo sapiens
aaggctctgagtagctcatgcttccagactga

SEQ ID NO: 5347 - DNA, 32 bp, Homo sapiens
accttggcctcctaggttcaagcaattctcct

SEQ ID NO: 5348 - DNA, 18 bp, Homo sapiens
gccatctcctgtcaggta

SEQ ID NO: 5349 - DNA, 23 bp, Homo sapiens
ggtgccaccgggttccccagggg

SEQ ID NO: 5350 - DNA, 32 bp, Homo sapiens
agatctggagacttaaaaagaaaacaaaaaca

SEQ ID NO: 5351 - DNA, 32 bp, Homo sapiens
gcttctcatccctgcatagatgcagtattctt

SEQ ID NO: 5352 - DNA, 32 bp, Homo sapiens
ctgagagccctctcctctggagcacacaccac

SEQ ID NO: 5353 - DNA, 32 bp, Homo sapiens
ccgagtccctctagcatctcccagaaggtgtc

SEQ ID NO: 5354 - DNA, 32 bp, Homo sapiens
aggttgcgtgttcttcgagttgggctaaagta

SEQ ID NO: 5355 - DNA, 32 bp, Homo sapiens
ttcttgggtgtttatcctatctctccaaccag

SEQ ID NO: 5356 - DNA, 32 bp, Homo sapiens
aggacctcaggctgctgtcatatatcacccgt

SEQ ID NO: 5357 - DNA, 32 bp, Homo sapiens
ctctgtcgcccaggctggagtgcagtgacatg

SEQ ID NO: 5358 - DNA, 32 bp, Homo sapiens
ggcatgtgcccaggtgagctcctgtgtgtgtc

SEQ ID NO: 5359 - DNA, 32 bp, Homo sapiens
aaaaatgtcttatggctgggtgcagtggctca

SEQ ID NO: 5360 - DNA, 32 bp, Homo sapiens
aatttcgggaggctgaggcaggagaacggcgt

SEQ ID NO: 5361 - DNA, 32 bp, Homo sapiens
gaacctgggaggcagcggttgcagtaagccaa

SEQ ID NO: 5362 - DNA, 32 bp, Homo sapiens
ctctgtcgcccaggctggaatgcagtggcatg

SEQ ID NO: 5363 - DNA, 32 bp, Homo sapiens
acctccgcctcccaggttcaagcgattctcct

SEQ ID NO: 5364 - DNA, 32 bp, Homo sapiens
gccggaccgagtgccctgcagttggtaggagt

SEQ ID NO: 5365 - DNA, 32 bp, Homo sapiens
gattctgggaggcaatggggagtgactgctaa

SEQ ID NO: 5366 - DNA, 32 bp, Homo sapiens
ctgaactcaagcaatcctcctgcctcagcctc

SEQ ID NO: 5367 - DNA, 32 bp, Homo sapiens
gcaaaaagtctgcaaaccccagggtcaagcct

SEQ ID NO: 5368 - DNA, 32 bp, Homo sapiens
cctgttgggaagaaaggaagaaaacaggtccc

SEQ ID NO: 5369 - DNA, 32 bp, Homo sapiens
actctgtcacccaggctggagagcaattgcac

SEQ ID NO: 5370 - DNA, 32 bp, Homo sapiens
actgtgtcacccagactggaatgcagtgacac

SEQ ID NO: 5371 - DNA, 32 bp, Homo sapiens
ctttaggtgatctttaaactatggtagtaaaa

SEQ ID NO: 5372 - DNA, 32 bp, Homo sapiens
ccctgccattggaacttggattactgtgaaca

SEQ ID NO: 5373 - DNA, 32 bp, Homo sapiens
tgactgagaagttagggtagaaaacaaaaagg

SEQ ID NO: 5374 - DNA, 32 bp, Homo sapiens
cagcacgtcgtgtagtcctttctgcctccagg

SEQ ID NO: 5375 - DNA, 21 bp, Homo sapiens
cgtgcctccagcacatgcggc

SEQ ID NO: 5376 - DNA, 21 bp, Homo sapiens
tgtggtctcaagagatggggg

SEQ ID NO: 5377 - DNA, 32 bp, Homo sapiens
cagaaagcctgaggcgtgcccagagcacaaga

SEQ ID NO: 5378 - DNA, 32 bp, Homo sapiens
gtcacacttcaaggaggcagctctctagacag

SEQ ID NO: 5379 - DNA, 32 bp, Homo sapiens
ctttaggttctttgctgcattctgcctctcta

SEQ ID NO: 5380 - DNA, 32 bp, Homo sapiens
ttcagatggagttttgttcttgttgcccaggc

SEQ ID NO: 5381 - DNA, 32 bp, Homo sapiens
tttctgctgctgctgacagattaacccaacaa

SEQ ID NO: 5382 - DNA, 32 bp, Homo sapiens
acccttaggagttcgatggagagaccatgagg

SEQ ID NO: 5383 - DNA, 32 bp, Homo sapiens
actgtgtcacccaggctggagtgcagtggcgc

SEQ ID NO: 5384 - DNA, 32 bp, Homo sapiens
actgtgtcgcccaggctggagtgcaagtggca

SEQ ID NO: 5385 - DNA, 32 bp, Homo sapiens
gttggagcagaactactgagaaaaaccaggca

SEQ ID NO: 5386 - DNA, 32 bp, Homo sapiens
ctagagatgcccatctggagtgagtgcaggac

SEQ ID NO: 5387 - DNA, 32 bp, Homo sapiens
cttattggtttgccatccttgttcattacaac

SEQ ID NO: 5388 - DNA, 24 bp, Homo sapiens
tggcacaatcatagctcactgcag

SEQ ID NO: 5389 - DNA, 32 bp, Homo sapiens
acccacaacatgaaagaaatggtgctacccag

SEQ ID NO: 5390 - DNA, 32 bp, Homo sapiens
agccttccaagtagctgggattacaggtgtgc

SEQ ID NO: 5391 - DNA, 32 bp, Homo sapiens
tgtaccttctccacctgcccccaggaaaaaga

SEQ ID NO: 5392 - DNA, 24 bp, Homo sapiens
tcacgcctgtggtctcagcacttt

SEQ ID NO: 5393 - DNA, 32 bp, Homo sapiens
ataaattcagaagggaggagatgtgtgtacag

SEQ ID NO: 5394 - DNA, 32 bp, Homo sapiens
gtctggcacatccttaatcctgtgcccctgcc

SEQ ID NO: 5395 - DNA, 32 bp, Homo sapiens
gtgcctgaagaagtctctcttctctctgcttc

SEQ ID NO: 5396 - DNA, 32 bp, Homo sapiens
agcggtggtcagacatggaaatggtggggaga

SEQ ID NO: 5397 - DNA, 32 bp, Homo sapiens
gatgaagttttcatccccatctgcctgttaat

SEQ ID NO: 5398 - DNA, 32 bp, Homo sapiens
agagccagctgcttgctcacagccacatttcc

SEQ ID NO: 5399 - DNA, 32 bp, Homo sapiens
cacttacatcatttggtacacagggtcaaata

SEQ ID NO: 5400 - DNA, 32 bp, Homo sapiens
tgcaatggctcagcttctcttccaacctgtcc

SEQ ID NO: 5401 - DNA, 32 bp, Homo sapiens
ttggtgttgcccaggcagagagggcagtgtgg

SEQ ID NO: 5402 - DNA, 32 bp, Homo sapiens
ctcttgtcgcccaggctggagtgcagtggcac

SEQ ID NO: 5403 - DNA, 30 bp, Homo sapiens
tcctgatggagtttcactatgttgcccagg

SEQ ID NO: 5404 - DNA, 32 bp, Homo sapiens
ctcttgttgcccaggctagagtgcaatggcat

SEQ ID NO: 5405 - DNA, 32 bp, Homo sapiens
actctgtcacccaggctggagtgcagtggtat

SEQ ID NO: 5406 - DNA, 32 bp, Homo sapiens
gctctgttgcccaggctggagtgtagtggtat

SEQ ID NO: 5407 - DNA, 32 bp, Homo sapiens
gctctgtcgcccaggctggagtacagtggtgt

SEQ ID NO: 5408 - DNA, 32 bp, Homo sapiens
gctctgtcacccaagctggagtgcagtggcac

SEQ ID NO: 5409 - DNA, 32 bp, Homo sapiens
actctgtcgcccaagctggagtgcagtggcac

SEQ ID NO: 5410 - DNA, 32 bp, Homo sapiens
ctcatgcctgtataatcccagcactttgggag

SEQ ID NO: 5411 - DNA, 28 bp, Homo sapiens
ggcaagtgaggtgctgccgtcatccagg

SEQ ID NO: 5412 - DNA, 32 bp, Homo sapiens
tcttgtccaggctggaggagtgcagtcgtaca

SEQ ID NO: 5413 - DNA, 32 bp, Homo sapiens
ttgggctgctgaggggctagtgcagtggtcct

SEQ ID NO: 5414 - DNA, 32 bp, Homo sapiens
ccgtcgcagctttgacatcttggtgtactcat

SEQ ID NO: 5415 - DNA, 32 bp, Homo sapiens
agaatgcctcttctcctccaaaggatcacaac

SEQ ID NO: 5416 - DNA, 32 bp, Homo sapiens
cggggcggaagaggaggaggaggaggaggaag

SEQ ID NO: 5417 - DNA, 32 bp, Homo sapiens
attaaagcctttattccatctctcaagatata

SEQ ID NO: 5418 - DNA, 32 bp, Homo sapiens
aaggaaaccctctcttcgtggggcactctgcc

SEQ ID NO: 5419 - DNA, 32 bp, Homo sapiens
ctctgccctttacttgaacaggagtcttgatt

SEQ ID NO: 5420 - DNA, 32 bp, Homo sapiens
attggaagaacaggagaaaaagaaaagcaaaa

SEQ ID NO: 5421 - DNA, 32 bp, Homo sapiens
catctgtcacccaggctggagtgcaatggcat

SEQ ID NO: 5422 - DNA, 32 bp, Homo sapiens
cagaaggtgggccgcttcctgtggaagaggga

SEQ ID NO: 5423 - DNA, 24 bp, Homo sapiens
tcacacctgtaatcctagcgcttt

SEQ ID NO: 5424 - DNA, 32 bp, Homo sapiens
gaagagaggagaggagagaggcagagagcggt

SEQ ID NO: 5425 - DNA, 32 bp, Homo sapiens
agggccggaagaggaaagaaaccagagtttct

SEQ ID NO: 5426 - DNA, 32 bp, Homo sapiens
aacaaacaactccgggcacaccacctttaaga

SEQ ID NO: 5427 - DNA, 32 bp, Homo sapiens
ttgcccctatcttgtgctcttctgtctgcagt

SEQ ID NO: 5428 - DNA, 32 bp, Homo sapiens
tttagatatttactccccattttatgatccgg

SEQ ID NO: 5429 - DNA, 24 bp, Homo sapiens
ctgcggcccggggctggagcgcag

SEQ ID NO: 5430 - DNA, 32 bp, Homo sapiens
atatcagctatttcctgtcttacttgaaaagt

SEQ ID NO: 5431 - DNA, 32 bp, Homo sapiens
tagcccagcctatcctaatgaactacctgatt

SEQ ID NO: 5432 - DNA, 32 bp, Homo sapiens
tttcttcccatctcttcttgctgcttagtgtc

SEQ ID NO: 5433 - DNA, 32 bp, Homo sapiens
ctctgtcgcccaggctggagtgcagtggcagg

SEQ ID NO: 5434 - DNA, 32 bp, Homo sapiens
gctagccctcctcctgaagcagtctaggagct

SEQ ID NO: 5435 - DNA, 32 bp, Homo sapiens
gtcctcaagggggaactggcactgtgacctta

SEQ ID NO: 5436 - DNA, 26 bp, Homo sapiens
acccctcaacctggctcatcaacaga

SEQ ID NO: 5437 - DNA, 32 bp, Homo sapiens
cgccggccacactggtcacaggcaaagtccag

SEQ ID NO: 5438 - DNA, 32 bp, Homo sapiens
ctctgttgcccagggtggagtgcagtggcatg

SEQ ID NO: 5439 - DNA, 32 bp, Homo sapiens
agtgtgagcacacgctggagtgcagcgttcca

SEQ ID NO: 5440 - DNA, 32 bp, Homo sapiens
atgaagtcacccattccatttgactctttagc

SEQ ID NO: 5441 - DNA, 32 bp, Homo sapiens
gagcccaggaggttgaggctgcagtgagttct

SEQ ID NO: 5442 - DNA, 32 bp, Homo sapiens
agatgccttccaggctgcagtcagtgcagatg

SEQ ID NO: 5443 - DNA, 32 bp, Homo sapiens
ctctgtggcccaggctggagtgcagtggcacg

SEQ ID NO: 5444 - DNA, 32 bp, Homo sapiens
tgcaaaacttcctggagttcagcccagcaagg

SEQ ID NO: 5445 - DNA, 32 bp, Homo sapiens
tgtttctcagtgttccttaacagcctgccttt

SEQ ID NO: 5446 - DNA, 32 bp, Homo sapiens
gaacccaggaggcacagcttgcagtgagcgaa

SEQ ID NO: 5447 - DNA, 32 bp, Homo sapiens
gtcttgaactcctggcctcaagcaatcctcct

SEQ ID NO: 5448 - DNA, 32 bp, Homo sapiens
ctgacctcaggtgatctgcccacctcggcttc

SEQ ID NO: 5449 - DNA, 32 bp, Homo sapiens
ctgacctcaagtgatctacccacctcggcttc

SEQ ID NO: 5450 - DNA, 32 bp, Homo sapiens
aagcggactgagtgctgggatccaaggcattc

SEQ ID NO: 5451 - DNA, 32 bp, Homo sapiens
ctaggagctgggaggaaaagaaaagaggggaa

SEQ ID NO: 5452 - DNA, 32 bp, Homo sapiens
gccctgtcacccaggctggagtgcaatggtgc

SEQ ID NO: 5453 - DNA, 32 bp, Homo sapiens
gccagctggattggccagtgcaccttgtattc

SEQ ID NO: 5454 - DNA, 32 bp, Homo sapiens
taaatgaggtggcttcagaaatggcagaataa

SEQ ID NO: 5455 - DNA, 32 bp, Homo sapiens
agacagcatcttctctattggcctctcaggga

SEQ ID NO: 5456 - DNA, 24 bp, Homo sapiens
tcacgcctgtaataccagcacttt

SEQ ID NO: 5457 - DNA, 32 bp, Homo sapiens
gatctgcccctgaacatctcccgagaaatgct

SEQ ID NO: 5458 - DNA, 32 bp, Homo sapiens
acttcagatgctttcaggagtgacacaagaac

SEQ ID NO: 5459 - DNA, 32 bp, Homo sapiens
cagcagcccctgcgccaacaccaccttctgct

SEQ ID NO: 5460 - DNA, 32 bp, Homo sapiens
aaagaagccagggtttgccactgtgaagcttg

SEQ ID NO: 5461 - DNA, 32 bp, Homo sapiens
tcaccggccagagaagaccactgtgagcattt

SEQ ID NO: 5462 - DNA, 32 bp, Homo sapiens
cccaggaactcctcggtccagagaccaagtgg

SEQ ID NO: 5463 - DNA, 28 bp, Homo sapiens
tcatcctaaagtgctggcctctcattcc

SEQ ID NO: 5464 - DNA, 32 bp, Homo sapiens
cagctagggaggcaaagcaggctgcagtcagt

SEQ ID NO: 5465 - DNA, 32 bp, Homo sapiens
tcttgtctctcaggctgggttgcaatggcaca

SEQ ID NO: 5466 - DNA, 32 bp, Homo sapiens
agcctcccgagtagctgggattacaggcgtgt

SEQ ID NO: 5467 - DNA, 32 bp, Homo sapiens
agcctcctgagtagctgggattataggcgtgt

SEQ ID NO: 5468 - DNA, 32 bp, Homo sapiens
ggaaggaaagagaccttcctggtcacacttgg

SEQ ID NO: 5469 - DNA, 32 bp, Homo sapiens
tgggaggctgaggcaggagaattgtttgacct

SEQ ID NO: 5470 - DNA, 32 bp, Homo sapiens
agcctcctgagtagctgggattacaggcgtgc

SEQ ID NO: 5471 - DNA, 32 bp, Homo sapiens
agcctcctgagtggctgggattacaggcatgc

SEQ ID NO: 5472 - DNA, 32 bp, Homo sapiens
tggctcactgcagcttaagctcactgcctggg

SEQ ID NO: 5473 - DNA, 32 bp, Homo sapiens
ttacacgggagaggagaatggatttataaaga

SEQ ID NO: 5474 - DNA, 32 bp, Homo sapiens
ggctcatgcctgtaatcccagcacttttgagg

SEQ ID NO: 5475 - DNA, 19 bp, Homo sapiens
ggtctccagaagccctgca

SEQ ID NO: 5476 - DNA, 32 bp, Homo sapiens
aggggaagagcctcagtcaggaggctctgtgg

SEQ ID NO: 5477 - DNA, 32 bp, Homo sapiens
ctctgtctcccaggctggagtgcagtggcacg

SEQ ID NO: 5478 - DNA, 32 bp, Homo sapiens
caggagcagccagcagtgcattcaccccactt

SEQ ID NO: 5479 - DNA, 23 bp, Homo sapiens
tggcgcattctaggctcactgca

SEQ ID NO: 5480 - DNA, 25 bp, Homo sapiens
acaggcatgagccaccacgcccggc

SEQ ID NO: 5481 - DNA, 32 bp, Homo sapiens
gctgtgttgcccaggctggagtgcagtggtgt

SEQ ID NO: 5482 - DNA, 32 bp, Homo sapiens
gccctgttgcccaggctggagagcagtggtgc

SEQ ID NO: 5483 - DNA, 32 bp, Homo sapiens
ttgttgaatgccagttttgaccacagaagaat

SEQ ID NO: 5484 - DNA, 32 bp, Homo sapiens
gctctgtcgcccaggctggagtgcagtcgtgc

SEQ ID NO: 5485 - DNA, 32 bp, Homo sapiens
actgtgtcacccaggctggagtgcagtggtgc

SEQ ID NO: 5486 - DNA, 32 bp, Homo sapiens
ttgccccgtaggaagctggagtgcgggcctcg

SEQ ID NO: 5487 - DNA, 32 bp, Homo sapiens
ctctgtctcccaggctggagtgcggtggcaca

SEQ ID NO: 5488 - DNA, 32 bp, Homo sapiens
ctctgtcgcccaggctggagtgcagtggcact

SEQ ID NO: 5489 - DNA, 32 bp, Homo sapiens
agagatccttccattccatctagtttttggaa

SEQ ID NO: 5490 - DNA, 32 bp, Homo sapiens
ttctgttgcccaagttggagtgcagtggcatg

SEQ ID NO: 5491 - DNA, 32 bp, Homo sapiens
ctctgttgcccaggttggagtgcagtggcact

SEQ ID NO: 5492 - DNA, 32 bp, Homo sapiens
ctctattgctcaggctggagtgtggtggcagg

SEQ ID NO: 5493 - DNA, 28 bp, Homo sapiens
tcgtctctcatccctgcctcatcttccg

SEQ ID NO: 5494 - DNA, 32 bp, Homo sapiens
gagctcaagaggttgaggctgcagtgagccct

SEQ ID NO: 5495 - DNA, 32 bp, Homo sapiens
ctctgttgcccaggctggagtgcagtggcatt

SEQ ID NO: 5496 - DNA, 32 bp, Homo sapiens
atattctgcaaatgtctcttggaacacactgc

SEQ ID NO: 5497 - DNA, 32 bp, Homo sapiens
acctccacctctcggcttcaagcaattctcct

SEQ ID NO: 5498 - DNA, 32 bp, Homo sapiens
agctcatgcctgtaatcccagcactttgggag

SEQ ID NO: 5499 - DNA, 32 bp, Homo sapiens
acgctgaggcctgggagtctcttgagctccac

SEQ ID NO: 5500 - DNA, 32 bp, Homo sapiens
gggcaggcctgaggctgggatcccgtgctgct

SEQ ID NO: 5501 - DNA, 32 bp, Homo sapiens
attttgagaactaataaatgcaccttaatggt

SEQ ID NO: 5502 - DNA, 32 bp, Homo sapiens
aagcttttaaccaattctcaaaccttactaaa

SEQ ID NO: 5503 - DNA, 32 bp, Homo sapiens
ccaggctcaagtgatcctcccacctcagtctc

SEQ ID NO: 5504 - DNA, 20 bp, Homo sapiens
gcccctgccccagcccaagt

SEQ ID NO: 5505 - DNA, 24 bp, Homo sapiens
tcatgcctgcaattccagcacttt

SEQ ID NO: 5506 - DNA, 25 bp, Homo sapiens
gatgaggaaactgaggctgagcggg

SEQ ID NO: 5507 - DNA, 19 bp, Homo sapiens
gtgggggtggagatgagga

SEQ ID NO: 5508 - DNA, 32 bp, Homo sapiens
tagtcctgtaggtcagcctttctcacaaactc

SEQ ID NO: 5509 - DNA, 32 bp, Homo sapiens
tgtctttgtaagtcagcatgctcttgcttgaa

SEQ ID NO: 5510 - DNA, 32 bp, Homo sapiens
ggtgttcacctttcactcatgagcaatgtgcc

SEQ ID NO: 5511 - DNA, 32 bp, Homo sapiens
cacgtcatgttgccttctcttttctttgtgtg

SEQ ID NO: 5512 - DNA, 32 bp, Homo sapiens
cttctggttttgtttcttgttctgcctgactg

SEQ ID NO: 5513 - DNA, 32 bp, Homo sapiens
caattattctaatctgaacacagttatcagga

SEQ ID NO: 5514 - DNA, 32 bp, Homo sapiens
ttctatcggccaggctggagtgcagtggtgca

SEQ ID NO: 5515 - DNA, 22 bp, Homo sapiens
ccaagcccaccagctttcagcg

SEQ ID NO: 5516 - DNA, 32 bp, Homo sapiens
ctcttgttgcccaggctggagtgaagtggcgt

SEQ ID NO: 5517 - DNA, 32 bp, Homo sapiens
catttatcagaaacttaaaatatttcataccg

SEQ ID NO: 5518 - DNA, 19 bp, Homo sapiens
cagagaatatttccagccc

SEQ ID NO: 5519 - DNA, 32 bp, Homo sapiens
tctctgtcacccaggctggagtgcagtggtgc

SEQ ID NO: 5520 - DNA, 32 bp, Homo sapiens
actgtgtcgcccaggctggagtgcagtggcgt

SEQ ID NO: 5521 - DNA, 32 bp, Homo sapiens
actctgtctcccaggctggagtgcagtggtgc

SEQ ID NO: 5522 - DNA, 32 bp, Homo sapiens
actctgttgcctaggctggagtgaaagtggcg

SEQ ID NO: 5523 - DNA, 32 bp, Homo sapiens
attctgttgcccatgctggagtgcagtggcgt

SEQ ID NO: 5524 - DNA, 32 bp, Homo sapiens
tctctgtcacccaggttggagtgcagtggtgt

SEQ ID NO: 5525 - DNA, 32 bp, Homo sapiens
ggcagtgactagtccaggagtgcagctgggag

SEQ ID NO: 5526 - DNA, 32 bp, Homo sapiens
ccaggctggtctccatcacctgatctcaggtg

SEQ ID NO: 5527 - DNA, 32 bp, Homo sapiens
gctgccaaagagactgggcgcagtggctcatg

SEQ ID NO: 5528 - DNA, 32 bp, Homo sapiens
tactccgggaggctgaggcaggagagtcactt

SEQ ID NO: 5529 - DNA, 32 bp, Homo sapiens
ctctgtcgcccaggctggagtgcactggcgcg

SEQ ID NO: 5530 - DNA, 32 bp, Homo sapiens
ctggctgttcctaaattcttaggatatgtccc

SEQ ID NO: 5531 - DNA, 32 bp, Homo sapiens
acctctgcctccttggttcaagcaattctcct

SEQ ID NO: 5532 - DNA, 32 bp, Homo sapiens
gaacccaggaggtagaagctgcagtgagcagg

SEQ ID NO: 5533 - DNA, 32 bp, Homo sapiens
acaggggttgggtgggggttgcaggactccac

SEQ ID NO: 5534 - DNA, 32 bp, Homo sapiens
cggccgccgggactcttcctggagacaccgcc

SEQ ID NO: 5535 - DNA, 32 bp, Homo sapiens
accactgcctccagggttcaagcgattctctt

SEQ ID NO: 5536 - DNA, 32 bp, Homo sapiens
agtctcccgaagtgctgggattactgacatga

SEQ ID NO: 5537 - DNA, 32 bp, Homo sapiens
cagcctctgagtagctgggactacaagtgcat

SEQ ID NO: 5538 - DNA, 32 bp, Homo sapiens
taaatctgtaccacctaacattgaacatcatt

SEQ ID NO: 5539 - DNA, 32 bp, Homo sapiens
tgcagacttgcgcttctctgcaccttatccct

SEQ ID NO: 5540 - DNA, 32 bp, Homo sapiens
cttccccaaggaactgctcccacctcagcacg

SEQ ID NO: 5541 - DNA, 32 bp, Homo sapiens
ggcacgaggcctgggcggctccgctagctgtt

SEQ ID NO: 5542 - DNA, 24 bp, Homo sapiens
tcacacctataattccagcacttt

SEQ ID NO: 5543 - DNA, 32 bp, Homo sapiens
gctagaaatagaaagaaaagaaaattgaacat

SEQ ID NO: 5544 - DNA, 32 bp, Homo sapiens
attttgtcaccgaggctggagtgcaatggccc

SEQ ID NO: 5545 - DNA, 32 bp, Homo sapiens
agaactttaaccggagcttcatctagtgattg

SEQ ID NO: 5546 - DNA, 32 bp, Homo sapiens
ggcattggaagtttagcctttacttgaatgta

SEQ ID NO: 5547 - DNA, 32 bp, Homo sapiens
tctctcctctccgcttctctccccctctgtct

SEQ ID NO: 5548 - DNA, 32 bp, Homo sapiens
ggagctgagaaaccgagtcactgtgaaaagat

SEQ ID NO: 5549 - DNA, 32 bp, Homo sapiens
ctagagatgctgctgccgcggttgcagttgtc

SEQ ID NO: 5550 - DNA, 32 bp, Homo sapiens
ttctgcctctgagggaaagcccagaaaaggac

SEQ ID NO: 5551 - DNA, 32 bp, Homo sapiens
ctctgtcgcccaggctggagtgcagtggcgcc

SEQ ID NO: 5552 - DNA, 32 bp, Homo sapiens
agtccaaaggacagtgtgtcactgtgaactgg

SEQ ID NO: 5553 - DNA, 32 bp, Homo sapiens
actcctgaagttctgttcgaccaaacatcaga

SEQ ID NO: 5554 - DNA, 32 bp, Homo sapiens
ctctgtcccccaggctggagtgcagtggcgcg

SEQ ID NO: 5555 - DNA, 32 bp, Homo sapiens
ctctgttgcccatgctggagtgcattggcaca

SEQ ID NO: 5556 - DNA, 32 bp, Homo sapiens
gtgcctgcctagtgctggagtaggggacaatg

SEQ ID NO: 5557 - DNA, 32 bp, Homo sapiens
gaacccgggaagcagaggttgcggtgagccga

SEQ ID NO: 5558 - DNA, 32 bp, Homo sapiens
aagcccagaaggcagaggttgtagtgagctga

SEQ ID NO: 5559 - DNA, 32 bp, Homo sapiens
ctctgtcgcctgggctggagtacagtggtgcg

SEQ ID NO: 5560 - DNA, 28 bp, Homo sapiens
gcccaagacccggctgcctcctcctctt

SEQ ID NO: 5561 - DNA, 28 bp, Homo sapiens
accccgggcagggctgcctcctcacctc

SEQ ID NO: 5562 - DNA, 32 bp, Homo sapiens
ccactcgggaggctgagacaggagaatcgctt

SEQ ID NO: 5563 - DNA, 32 bp, Homo sapiens
acctccgcctcctgggttcaagcgattctcgt

SEQ ID NO: 5564 - DNA, 32 bp, Homo sapiens
acctcctcctcctggattcaagcaattctctt

SEQ ID NO: 5565 - DNA, 28 bp, Homo sapiens
tgtgcccacgctgctgcctgctccagac

SEQ ID NO: 5566 - DNA, 32 bp, Homo sapiens
acctccccctcctgggttcaagcgattctcct

SEQ ID NO: 5567 - DNA, 32 bp, Homo sapiens
acctctgcctcctgggttcaagcgattcttgt

SEQ ID NO: 5568 - DNA, 32 bp, Homo sapiens
acctccgcctcctgggttcaagggattctcct

SEQ ID NO: 5569 - DNA, 32 bp, Homo sapiens
ctagcaggaagaggacaaagagacagagccca

SEQ ID NO: 5570 - DNA, 32 bp, Homo sapiens
agaactctctggcactatgggcacttgcacat

SEQ ID NO: 5571 - DNA, 32 bp, Homo sapiens
acttccagctcctgggttcgaacgattctcct

SEQ ID NO: 5572 - DNA, 32 bp, Homo sapiens
ttccaactttgtcagtcttttctgcctcaact

SEQ ID NO: 5573 - DNA, 32 bp, Homo sapiens
actgatcttgggtttcctattctgcctcccct

SEQ ID NO: 5574 - DNA, 32 bp, Homo sapiens
ttagaaaaatggggagaaagctggaagaacaa

SEQ ID NO: 5575 - DNA, 32 bp, Homo sapiens
gccagtccctcgttgcaggacagggtcatcat

SEQ ID NO: 5576 - DNA, 32 bp, Homo sapiens
ggcgctcctaacctcccgaacggggcggctgg

SEQ ID NO: 5577 - DNA, 32 bp, Homo sapiens
gtgcgctctgcagcatgtcgctacatgcctgg

SEQ ID NO: 5578 - DNA, 32 bp, Homo sapiens
ctttgcatatccatgttctaccacaggaaggt

SEQ ID NO: 5579 - DNA, 32 bp, Homo sapiens
ccacctgtgctgctgcaccaacctcactgccc

SEQ ID NO: 5580 - DNA, 32 bp, Homo sapiens
cctgagcccctctctgctgccagacaccccct

SEQ ID NO: 5581 - DNA, 32 bp, Homo sapiens
actctgtctcccaggctggactgcagtggtgc

SEQ ID NO: 5582 - DNA, 32 bp, Homo sapiens
gctctgtcgcccaggctgcagtgcggtggtgc

SEQ ID NO: 5583 - DNA, 32 bp, Homo sapiens
atgggcccagttctgggagaggacagaaaagg

SEQ ID NO: 5584 - DNA, 32 bp, Homo sapiens
actctgttgcccaggctgcagtgcagtggtgt

SEQ ID NO: 5585 - DNA, 32 bp, Homo sapiens
ctctgtccgcccaggctgggtgcagtcacggc

SEQ ID NO: 5586 - DNA, 32 bp, Homo sapiens
tgcaggttgcccaggaggagctgcagcgccag

SEQ ID NO: 5587 - DNA, 32 bp, Homo sapiens
atgggatcaggtgcccttatgaaaaggcttga

SEQ ID NO: 5588 - DNA, 32 bp, Homo sapiens
tgagcccagaggcggaggttgcagtgagccga

SEQ ID NO: 5589 - DNA, 32 bp, Homo sapiens
gctctgttgccaggctggagggcagtggcacg

SEQ ID NO: 5590 - DNA, 32 bp, Homo sapiens
acctccgcctcccgggttcaagtaattctgct

SEQ ID NO: 5591 - DNA, 32 bp, Homo sapiens
gagaaggactgcacttagaactgcattttggc

SEQ ID NO: 5592 - DNA, 32 bp, Homo sapiens
agcctcctgagtagctgggatgacaggtgcac

SEQ ID NO: 5593 - DNA, 32 bp, Homo sapiens
agattcaaagacgaccttccatgtgatgcaca

SEQ ID NO: 5594 - DNA, 32 bp, Homo sapiens
atcctgccacttctatgtctctggaccacagg

SEQ ID NO: 5595 - DNA, 32 bp, Homo sapiens
gcaaatagaagagagaggttgaaaaacaaaat

SEQ ID NO: 5596 - DNA, 32 bp, Homo sapiens
actctgtcacccaagctatggtgcagtggcac

SEQ ID NO: 5597 - DNA, 32 bp, Homo sapiens
ctctgtcatccaggctggagtgcagtgatgcg

SEQ ID NO: 5598 - DNA, 32 bp, Homo sapiens
ctctgtcacccaggctggagtacagtgacacg

SEQ ID NO: 5599 - DNA, 32 bp, Homo sapiens
gatggtattgcagcttcactgcctgcgttcct

SEQ ID NO: 5600 - DNA, 32 bp, Homo sapiens
ccgagggccgtctctcccagccgaacacagcc

SEQ ID NO: 5601 - DNA, 21 bp, Homo sapiens
gtccaggctggagtgcaatag

SEQ ID NO: 5602 - DNA, 32 bp, Homo sapiens
ccagctggagcctcttgagggagatgagaggc

SEQ ID NO: 5603 - DNA, 32 bp, Homo sapiens
ctttgcaaacagtttgaatactgtgaattcat

SEQ ID NO: 5604 - DNA, 32 bp, Homo sapiens
ttgagatggagtttcagtcttgttgcccaggc

SEQ ID NO: 5605 - DNA, 32 bp, Homo sapiens
cagcagcccctcccatcacaggctcagggacc

SEQ ID NO: 5606 - DNA, 32 bp, Homo sapiens
gtcttggcctcagatggatggatgtgtttgga

SEQ ID NO: 5607 - DNA, 32 bp, Homo sapiens
cttggaaaagagactcatttgctgatggttca

SEQ ID NO: 5608 - DNA, 32 bp, Homo sapiens
gcggcttgtcccaggctgctgggctgtggtct

SEQ ID NO: 5609 - DNA, 32 bp, Homo sapiens
ctctgttgcccagctggagtgcagtggcgtga

SEQ ID NO: 5610 - DNA, 32 bp, Homo sapiens
ctctgtcacccgggctggagtgcagtggcgcg

SEQ ID NO: 5611 - DNA, 32 bp, Homo sapiens
atccatctctgagatggatgagaatctgagtc

SEQ ID NO: 5612 - DNA, 32 bp, Homo sapiens
actcgaacccgtccttttcacaacagccgcgg

SEQ ID NO: 5613 - DNA, 32 bp, Homo sapiens
gaacctgggaggcagagcttgcagtgagccta

SEQ ID NO: 5614 - DNA, 32 bp, Homo sapiens
gagactaggagtttgaggctgcagtgaactaa

SEQ ID NO: 5615 - DNA, 32 bp, Homo sapiens
ctcgcactctggcactgctccctctgaagtgc

SEQ ID NO: 5616 - DNA, 32 bp, Homo sapiens
tgatagagaaattggcccgctttgtggcagaa

SEQ ID NO: 5617 - DNA, 32 bp, Homo sapiens
tcaaaaacaacaacaacaacaaaaaccctatt

SEQ ID NO: 5618 - DNA, 32 bp, Homo sapiens
gtccctgccctcccctgctcccaggttgaggt

SEQ ID NO: 5619 - DNA, 32 bp, Homo sapiens
ctggagcttagggattctccccaccccagccc

SEQ ID NO: 5620 - DNA, 32 bp, Homo sapiens
agcctcctgagtagctgggactacagttgtgc

SEQ ID NO: 5621 - DNA, 32 bp, Homo sapiens
tggcctcctgggtgctgggattacagacgtga

SEQ ID NO: 5622 - DNA, 32 bp, Homo sapiens
ctctgtcacccagactggagtgcaatggcttg

SEQ ID NO: 5623 - DNA, 21 bp, Homo sapiens
tcacacctgtaatcccagtac

SEQ ID NO: 5624 - DNA, 32 bp, Homo sapiens
cccaggtcacccaaccagcgagtggcagaact

SEQ ID NO: 5625 - DNA, 32 bp, Homo sapiens
cctggtgtggtgctgctccctcacctccaaaa

SEQ ID NO: 5626 - DNA, 32 bp, Homo sapiens
ctgctgctgctgctgctgctaatcttcagggc

SEQ ID NO: 5627 - DNA, 18 bp, Homo sapiens
gccatcactttttcagga

SEQ ID NO: 5628 - DNA, 19 bp, Homo sapiens
gaagctgtcaccacagttc

SEQ ID NO: 5629 - DNA, 32 bp, Homo sapiens
atccaatgttgacttagccatggtagaactct

SEQ ID NO: 5630 - DNA, 32 bp, Homo sapiens
tttaggtggagtttcactctgttgcccaggct

SEQ ID NO: 5631 - DNA, 32 bp, Homo sapiens
ctctgtcactcaggctggagtgcggtggtata

SEQ ID NO: 5632 - DNA, 32 bp, Homo sapiens
tcctgccgcccaggcaggatgtcagatgagga

SEQ ID NO: 5633 - DNA, 32 bp, Homo sapiens
ttggtggggtacagtggatgtgaatactgtaa

SEQ ID NO: 5634 - DNA, 32 bp, Homo sapiens
tggcttcttagagtgagagaagtatgtggaca

SEQ ID NO: 5635 - DNA, 32 bp, Homo sapiens
gaaccagggaggcggaggttgcagcaagccaa

SEQ ID NO: 5636 - DNA, 32 bp, Homo sapiens
ctctgttacccaggccggagtgcagtggcgca

SEQ ID NO: 5637 - DNA, 32 bp, Homo sapiens
atccactgagccttcatctcccatgaacttga

SEQ ID NO: 5638 - DNA, 32 bp, Homo sapiens
agcatagtttcttaagacagaggccatttggt

SEQ ID NO: 5639 - DNA, 32 bp, Homo sapiens
ctgggctcaagcaattgtccctcctcagcctc

SEQ ID NO: 5640 - DNA, 32 bp, Homo sapiens
gaggtttggggccagacccccactagctggga

SEQ ID NO: 5641 - DNA, 32 bp, Homo sapiens
gccagccaggcagcttctctgcctgggagggg

SEQ ID NO: 5642 - DNA, 32 bp, Homo sapiens
cctcatttctcagcttctgcatttccttccct

SEQ ID NO: 5643 - DNA, 32 bp, Homo sapiens
ttaattatgcactttgtcctctggaccatttt

SEQ ID NO: 5644 - DNA, 32 bp, Homo sapiens
gaagtagcctgaggccctcaccagaagcagac

SEQ ID NO: 5645 - DNA, 32 bp, Homo sapiens
tgttttctgcaaggagctgccagccatctaac

SEQ ID NO: 5646 - DNA, 32 bp, Homo sapiens
actcttaactctataaacaaccacctttcaca

SEQ ID NO: 5647 - DNA, 32 bp, Homo sapiens
ttttagggcaagtataggttgcactgatcctg

SEQ ID NO: 5648 - DNA, 32 bp, Homo sapiens
tgtatgttgcccatggtgggagcgtggtcact

SEQ ID NO: 5649 - DNA, 32 bp, Homo sapiens
tcagagggtacttggcatcaccggtgcacagc

SEQ ID NO: 5650 - DNA, 32 bp, Homo sapiens
taaagaagactgactagatgcatctttctttg

SEQ ID NO: 5651 - DNA, 32 bp, Homo sapiens
ttaattgctagcaaggctgagcacttttccat

SEQ ID NO: 5652 - DNA, 32 bp, Homo sapiens
ccccggcctcttctccatcctgcttggaccag

SEQ ID NO: 5653 - DNA, 31 bp, Homo sapiens
tcccagccacagccaggcaggagggagaagc

SEQ ID NO: 5654 - DNA, 19 bp, Homo sapiens
gccttttgctgtcctggta

SEQ ID NO: 5655 - DNA, 22 bp, Homo sapiens
gtgacccaggctggaatgcaat

SEQ ID NO: 5656 - DNA, 32 bp, Homo sapiens
tgctggagggcatcctggatggaattgaagtg

SEQ ID NO: 5657 - DNA, 32 bp, Homo sapiens
aggcatttgcagggtcctcttctgggcctgac

SEQ ID NO: 5658 - DNA, 32 bp, Homo sapiens
ctccaagttctctcttcctgtcccacactctg

SEQ ID NO: 5659 - DNA, 32 bp, Homo sapiens
ctgctccctaacctttcgccgaatggggcaga

SEQ ID NO: 5660 - DNA, 32 bp, Homo sapiens
gccgaagcctgaggaagctcatcatgagattc

SEQ ID NO: 5661 - DNA, 32 bp, Homo sapiens
ttgagatggagtttcgcgcttgttgcccaggc

SEQ ID NO: 5662 - DNA, 32 bp, Homo sapiens
tcattgtgactgctgctctcattgctatcatg

SEQ ID NO: 5663 - DNA, 32 bp, Homo sapiens
tcttcggccctctcctgtcgccgccatgagca

SEQ ID NO: 5664 - DNA, 32 bp, Homo sapiens
actctgtcatccaggctggagtgcagtggtgt

SEQ ID NO: 5665 - DNA, 32 bp, Homo sapiens
actctgtggcccaggctggagtgcagtggcat

SEQ ID NO: 5666 - DNA, 32 bp, Homo sapiens
ttttaaattataacttaaaatattttataatt

SEQ ID NO: 5667 - DNA, 32 bp, Homo sapiens
ctctatcacccaggctgaagtgcagtggtacg

SEQ ID NO: 5668 - DNA, 32 bp, Homo sapiens
cccaggacatgttcgacaatggcagctttctc

SEQ ID NO: 5669 - DNA, 32 bp, Homo sapiens
gctttgaaagagaaactggctcacagtgagtg

SEQ ID NO: 5670 - DNA, 32 bp, Homo sapiens
tagtgacccagtgccctcactgcccagccccg

SEQ ID NO: 5671 - DNA, 32 bp, Homo sapiens
gaacccgagagacggaggttgcagtgagctga

SEQ ID NO: 5672 - DNA, 32 bp, Homo sapiens
ctctgttgcctaggctggagtacagtggtgca

SEQ ID NO: 5673 - DNA, 32 bp, Homo sapiens
ccgggttcaagtaattctcctgcctcaggctt

SEQ ID NO: 5674 - DNA, 32 bp, Homo sapiens
gatgactgtacaacaggaagacttgaaaaatc

SEQ ID NO: 5675 - DNA, 16 bp, Homo sapiens
aggccaggcgcagtgg

SEQ ID NO: 5676 - DNA, 32 bp, Homo sapiens
atgcttcctgcccttgaacatcagactccaag

SEQ ID NO: 5677 - DNA, 32 bp, Homo sapiens
caacttggaagaggaaagaaaagaagtcagga

SEQ ID NO: 5678 - DNA, 32 bp, Homo sapiens
gtgaactgcttaggtaggagtgcactgcagtt

SEQ ID NO: 5679 - DNA, 32 bp, Homo sapiens
aagagtgtgctgcccctccccatctccatgcc

SEQ ID NO: 5680 - DNA, 24 bp, Homo sapiens
gttgcccaggctggagtgcaatga

SEQ ID NO: 5681 - DNA, 32 bp, Homo sapiens
ctctgtggcccaggctggcgtgcagtgggccg

SEQ ID NO: 5682 - DNA, 32 bp, Homo sapiens
tgttgctgcccaggctctagatcacatggcat

SEQ ID NO: 5683 - DNA, 32 bp, Homo sapiens
ctgtgtcatgcaggctggagtgcagtggcatg

SEQ ID NO: 5684 - DNA, 32 bp, Homo sapiens
ctgcaaggctctaggtgtgacaacagcagttg

SEQ ID NO: 5685 - DNA, 32 bp, Homo sapiens
agaagggaaaggcagagggtgtgattatggtg

SEQ ID NO: 5686 - DNA, 32 bp, Homo sapiens
gaacccgggaggcggaggttacagtgagcctt

SEQ ID NO: 5687 - DNA, 32 bp, Homo sapiens
gggaaggccgctgggagcatgaacttctgagc

SEQ ID NO: 5688 - DNA, 32 bp, Homo sapiens
agcctccccagtagctgggattacaggcacct

SEQ ID NO: 5689 - DNA, 32 bp, Homo sapiens
agcctcctgagtagctgggactacaggcgcca

SEQ ID NO: 5690 - DNA, 32 bp, Homo sapiens
ggaaccctttttctccccgctgtggcctctgc

SEQ ID NO: 5691 - DNA, 32 bp, Homo sapiens
gggtccacgtttctccccggctcctctgggct

SEQ ID NO: 5692 - DNA, 32 bp, Homo sapiens
cctcagagaagaggtggtttagagcaaggaaa

SEQ ID NO: 5693 - DNA, 21 bp, Homo sapiens
gcacgatcttggctcaccgca

SEQ ID NO: 5694 - DNA, 20 bp, Homo sapiens
tgctgaatcactgttgctga

SEQ ID NO: 5695 - DNA, 32 bp, Homo sapiens
ctctgttgcccaggctgcagtgcagtggtgcc

SEQ ID NO: 5696 - DNA, 32 bp, Homo sapiens
ccctggagagcagcagggggccttcactcctg

SEQ ID NO: 5697 - DNA, 21 bp, Homo sapiens
gcacgatctcggctcactgca

SEQ ID NO: 5698 - DNA, 21 bp, Homo sapiens
gcgcgatctcagctcactgca

SEQ ID NO: 5699 - DNA, 32 bp, Homo sapiens
cggactgggacttggctttctccggataagcg

SEQ ID NO: 5700 - DNA, 32 bp, Homo sapiens
gttcaagatcagcttgtgcaatgtatcaaaac

SEQ ID NO: 5701 - DNA, 17 bp, Homo sapiens
cagggaagcctcccagc

SEQ ID NO: 5702 - DNA, 32 bp, Homo sapiens
ctaaactgagcagtctcataccatggagagat

SEQ ID NO: 5703 - DNA, 24 bp, Homo sapiens
ctggcgaacatggtgagacccatc

SEQ ID NO: 5704 - DNA, 32 bp, Homo sapiens
gctgaggaaacttggctgtaacttcaaaagaa

SEQ ID NO: 5705 - DNA, 32 bp, Homo sapiens
tggcccccaagtgccctgggccgtggctccct

SEQ ID NO: 5706 - DNA, 32 bp, Homo sapiens
tgggaggccgaggcgggtggatcatgtgaggc

SEQ ID NO: 5707 - DNA, 32 bp, Homo sapiens
cttgggctgctgaggggctagtgcagtggtcc

SEQ ID NO: 5708 - DNA, 32 bp, Homo sapiens
ttccaacctaagatagttaactacctgagacc

SEQ ID NO: 5709 - DNA, 32 bp, Homo sapiens
ggagccagtgagacaggaaaaacctagtaacg

SEQ ID NO: 5710 - DNA, 32 bp, Homo sapiens
ctggaagtcttcacactggagttgctgttcca

SEQ ID NO: 5711 - DNA, 32 bp, Homo sapiens
taagtcactcccagactagggaagtgactcag

SEQ ID NO: 5712 - DNA, 32 bp, Homo sapiens
agtctcccgagtagctgggattacaggcgtgc

SEQ ID NO: 5713 - DNA, 21 bp, Homo sapiens
aatgaggaaacaggttatgga

SEQ ID NO: 5714 - DNA, 32 bp, Homo sapiens
cagaggaagaggaaagaaagaagaggagggaa

SEQ ID NO: 5715 - DNA, 32 bp, Homo sapiens
gcccaagtcccccacactcagtgcagtgatga

SEQ ID NO: 5716 - DNA, 32 bp, Homo sapiens
cgcctctctgcagcctttcacttcagtgccca

SEQ ID NO: 5717 - DNA, 32 bp, Homo sapiens
cacctgcatcttctgatcacctggcccagaag

SEQ ID NO: 5718 - DNA, 31 bp, Homo sapiens
aaggcagtcaacacaagagggatggatcatt

SEQ ID NO: 5719 - DNA, 32 bp, Homo sapiens
agacacctctgagtaaactcccagaaagcctg

SEQ ID NO: 5720 - DNA, 27 bp, Homo sapiens
gcagcagcaaaggcaccataagtcaaa

SEQ ID NO: 5721 - DNA, 32 bp, Homo sapiens
ttattaatcataggagcttgcagtctcactag

SEQ ID NO: 5722 - DNA, 21 bp, Homo sapiens
cctcccctgtcccctcgggca

SEQ ID NO: 5723 - DNA, 32 bp, Homo sapiens
ggcccccgtctgctgctggacacagagccatg

SEQ ID NO: 5724 - DNA, 32 bp, Homo sapiens
ttccttcctctgtccggagaggcacaggtgtc

SEQ ID NO: 5725 - DNA, 32 bp, Homo sapiens
actctcttgcccaggtaagctggggcagagcc

SEQ ID NO: 5726 - DNA, 32 bp, Homo sapiens
aaccagttgctgctgtcatacccctggcaggg

SEQ ID NO: 5727 - DNA, 32 bp, Homo sapiens
gctggaaatacttggaatattttccagagtct

SEQ ID NO: 5728 - DNA, 32 bp, Homo sapiens
agtgatcacatcctgattgagtggctatggac

SEQ ID NO: 5729 - DNA, 32 bp, Homo sapiens
aatggatggatggatggatggatgttggtgaa

SEQ ID NO: 5730 - DNA, 32 bp, Homo sapiens
actctgttgaccaggctggagtgcagtggtga

SEQ ID NO: 5731 - DNA, 32 bp, Homo sapiens
ttgctgccaagtgcgaataaacggcgtgattg

SEQ ID NO: 5732 - DNA, 32 bp, Homo sapiens
gaacctgggaggcggaggttgcagtaagccca

SEQ ID NO: 5733 - DNA, 32 bp, Homo sapiens
ccttgaagcccaggctgatgcttgaagtaact

SEQ ID NO: 5734 - DNA, 32 bp, Homo sapiens
agccttccgagtagctgggattacaggcaccc

SEQ ID NO: 5735 - DNA, 32 bp, Homo sapiens
cctaaaagacaattttccttggaacacataag

SEQ ID NO: 5736 - DNA, 32 bp, Homo sapiens
gatagcaggaaggcagaaagaaaacataaaga

SEQ ID NO: 5737 - DNA, 32 bp, Homo sapiens
aggttgggaaatgaggaatgagcctgacaccc

SEQ ID NO: 5738 - DNA, 32 bp, Homo sapiens
tttgaatacttgtttctttagcactttgaaga

SEQ ID NO: 5739 - DNA, 32 bp, Homo sapiens
aagaatatgttgtgagcatctttccatgatat

SEQ ID NO: 5740 - DNA, 26 bp, Homo sapiens
gcagggctgggggctccggagagcag

SEQ ID NO: 5741 - DNA, 32 bp, Homo sapiens
ggaaggaaggaaggagaaaggaaaggaaggca

SEQ ID NO: 5742 - DNA, 32 bp, Homo sapiens
acacaaccagaaggagctgagtttggcaacaa

SEQ ID NO: 5743 - DNA, 32 bp, Homo sapiens
tttcgccccaaaataatgagacctcacctggt

SEQ ID NO: 5744 - DNA, 32 bp, Homo sapiens
cttcattactgcccttctcttgctgcctcctg

SEQ ID NO: 5745 - DNA, 20 bp, Homo sapiens
gcaaatgcaataatgccctc

SEQ ID NO: 5746 - DNA, 32 bp, Homo sapiens
ccttgtcacccaggctagagtgcagtggcacg

SEQ ID NO: 5747 - DNA, 32 bp, Homo sapiens
ggtgctgccggtggagcttcaggtcttgatag

SEQ ID NO: 5748 - DNA, 32 bp, Homo sapiens
gagtgacagcctttttatggttggtgttacta

SEQ ID NO: 5749 - DNA, 23 bp, Homo sapiens
tggcaccatctcggctcactcca

SEQ ID NO: 5750 - DNA, 23 bp, Homo sapiens
tggcaccatctccgctcactgca

SEQ ID NO: 5751 - DNA, 32 bp, Homo sapiens
actcagtcgcccaggctggagtgcagtggcat

SEQ ID NO: 5752 - DNA, 32 bp, Homo sapiens
cctgtctcaaagaaagaaagaaagaaaagaaa

SEQ ID NO: 5753 - DNA, 32 bp, Homo sapiens
aacaggaaatattggcttatctctgtaggaag

SEQ ID NO: 5754 - DNA, 32 bp, Homo sapiens
cgggtcgggaggctgtgctggctgcactggcc

SEQ ID NO: 5755 - DNA, 32 bp, Homo sapiens
gctctgtcgccaggctggagtgcagtggcgtg

SEQ ID NO: 5756 - DNA, 32 bp, Homo sapiens
ctctgttgtccaggctagagtgcagtggtgtg

SEQ ID NO: 5757 - DNA, 28 bp, Homo sapiens
tcccttccagggttcgcctcatctgagg

SEQ ID NO: 5758 - DNA, 32 bp, Homo sapiens
ccacctgcccactcccttaacaagagttttat

SEQ ID NO: 5759 - DNA, 32 bp, Homo sapiens
tgaacccgggggcagaggctgcagtgagccga

SEQ ID NO: 5760 - DNA, 32 bp, Homo sapiens
gggaaggctgaggtaggagaatcttttgaatc

SEQ ID NO: 5761 - DNA, 26 bp, Homo sapiens
tcatgcctataaaattccagcacttt

SEQ ID NO: 5762 - DNA, 32 bp, Homo sapiens
ctagcctcaagcaatccacccacctcagcctt

SEQ ID NO: 5763 - DNA, 32 bp, Homo sapiens
acttgtatatcccactgggagcactttgtagg

SEQ ID NO: 5764 - DNA, 32 bp, Homo sapiens
cttggagcattatctttagttacttgaagagt

SEQ ID NO: 5765 - DNA, 19 bp, Homo sapiens
ggcagccagagggcagctg

SEQ ID NO: 5766 - DNA, 21 bp, Homo sapiens
gcccctgcctctgcccaagtg

SEQ ID NO: 5767 - DNA, 32 bp, Homo sapiens
caggtccccaagtcccttcacagggtccccac

SEQ ID NO: 5768 - DNA, 32 bp, Homo sapiens
tcttgtcacccaggctggagtgcagtggcgca

SEQ ID NO: 5769 - DNA, 32 bp, Homo sapiens
tcttctccagggcctcattcagtctcagacca

SEQ ID NO: 5770 - DNA, 23 bp, Homo sapiens
tggcacgatcatagctcactgta

SEQ ID NO: 5771 - DNA, 17 bp, Homo sapiens
acaggcgcccaccaccc

SEQ ID NO: 5772 - DNA, 32 bp, Homo sapiens
ctgccctctgtttgcaggcacagggtcacagt

SEQ ID NO: 5773 - DNA, 32 bp, Homo sapiens
ttttgggagccagcggtatggcgtcgggctgc

SEQ ID NO: 5774 - DNA, 21 bp, Homo sapiens
gcatgatctcggctcactgca

SEQ ID NO: 5775 - DNA, 21 bp, Homo sapiens
gcgtgatctcagctcactgca

SEQ ID NO: 5776 - DNA, 32 bp, Homo sapiens
ctcttgttgcccaggctggagtgcaacggcat

SEQ ID NO: 5777 - DNA, 32 bp, Homo sapiens
tcgctgttgcccaggctgtagtgcagtggtgc

SEQ ID NO: 5778 - DNA, 32 bp, Homo sapiens
tgatccttcctactttgcttctctccacccat

SEQ ID NO: 5779 - DNA, 32 bp, Homo sapiens
ctctttcgcccaggccggactgcagtggcagg

SEQ ID NO: 5780 - DNA, 32 bp, Homo sapiens
aggactgtggccatggtgtgtgcagtggcccc

SEQ ID NO: 5781 - DNA, 32 bp, Homo sapiens
ctttgtcacgcaggctagagtgcagtggcgca

SEQ ID NO: 5782 - DNA, 32 bp, Homo sapiens
gagcccaggaggcagaggctgcagtgagccga

SEQ ID NO: 5783 - DNA, 32 bp, Homo sapiens
ctccattgcccaggctggattacagtggcgca

SEQ ID NO: 5784 - DNA, 32 bp, Homo sapiens
ccttgttgcccaggctgtagtacaatggcatg

SEQ ID NO: 5785 - DNA, 32 bp, Homo sapiens
catgccccaacaagaggaagactgtctggctc

SEQ ID NO: 5786 - DNA, 32 bp, Homo sapiens
tgcgaggaaagccgtttcctggaacatcggaa

SEQ ID NO: 5787 - DNA, 32 bp, Homo sapiens
acttccgcctcctgtgttcaagcgattctcct

SEQ ID NO: 5788 - DNA, 32 bp, Homo sapiens
ccaggctcaagtgatcctcccaccccagcctc

SEQ ID NO: 5789 - DNA, 32 bp, Homo sapiens
tgcttctccagcctttctcccatttcagtaag

SEQ ID NO: 5790 - DNA, 32 bp, Homo sapiens
agtctcctgagtagctgggatcacagggacca

SEQ ID NO: 5791 - DNA, 32 bp, Homo sapiens
cttccccctgcagctactcttcagatctggct

SEQ ID NO: 5792 - DNA, 32 bp, Homo sapiens
ggctccatccttctccccaaggtctgtggctc

SEQ ID NO: 5793 - DNA, 32 bp, Homo sapiens
aaagaaaatttccaagcatggtatcatctcac

SEQ ID NO: 5794 - DNA, 32 bp, Homo sapiens
cactttgctcccaggctggaatgcagtggcta

SEQ ID NO: 5795 - DNA, 32 bp, Homo sapiens
cagggacctcaaggagctatgaacatagaaac

SEQ ID NO: 5796 - DNA, 32 bp, Homo sapiens
cccgttcctcaagggattcctggctggctatg

SEQ ID NO: 5797 - DNA, 32 bp, Homo sapiens
ggcgccgggaggccgagccagcgactaagagg

SEQ ID NO: 5798 - DNA, 32 bp, Homo sapiens
actcgttgcccaggctggagtgcagtggcgca

SEQ ID NO: 5799 - DNA, 32 bp, Homo sapiens
gtctttaatgttctttttggagttaggacctc

SEQ ID NO: 5800 - DNA, 32 bp, Homo sapiens
gctcaggggaggcaggaagatgaaggactgtt

SEQ ID NO: 5801 - DNA, 32 bp, Homo sapiens
tgtgtagggttggggagagtgcagtgatggga

SEQ ID NO: 5802 - DNA, 32 bp, Homo sapiens
gagctcaagaggccgaggttgcagtgagccgt

SEQ ID NO: 5803 - DNA, 28 bp, Homo sapiens
tatcccccaagtgccttccctcatgcct

SEQ ID NO: 5804 - DNA, 28 bp, Homo sapiens
tgccgtcccccgactgcctcattctttg

SEQ ID NO: 5805 - DNA, 32 bp, Homo sapiens
tgactgagggggcagaggcagtggctctttag

SEQ ID NO: 5806 - DNA, 32 bp, Homo sapiens
cctaagccccatcgtagcacagtattacatgt

SEQ ID NO: 5807 - DNA, 32 bp, Homo sapiens
tttccccagcatttccaaaactacctagtccc

SEQ ID NO: 5808 - DNA, 32 bp, Homo sapiens
agcccctctgcagctcacccttggcttgtttt

SEQ ID NO: 5809 - DNA, 19 bp, Homo sapiens
gcaggaggaggaagagcgg

SEQ ID NO: 5810 - DNA, 32 bp, Homo sapiens
atttttagaggaacagaaagaaagtgaaaaga

SEQ ID NO: 5811 - DNA, 32 bp, Homo sapiens
agacagcccctatcctccattcttgagtcagg

SEQ ID NO: 5812 - DNA, 32 bp, Homo sapiens
gtttagcatccttgcagaattacttgagaagg

SEQ ID NO: 5813 - DNA, 32 bp, Homo sapiens
cctttcagcaagacttctctttgcctcaaata

SEQ ID NO: 5814 - DNA, 25 bp, Homo sapiens
gttttcatctggtgtcttttattta

SEQ ID NO: 5815 - DNA, 32 bp, Homo sapiens
agagctagcccaggccaggggtcaatgttcat

SEQ ID NO: 5816 - DNA, 32 bp, Homo sapiens
ctctgtcacccagtctggagtgcagtggtgtg

SEQ ID NO: 5817 - DNA, 32 bp, Homo sapiens
ctgtgacacccagccaagcaggcacaggagga

SEQ ID NO: 5818 - DNA, 32 bp, Homo sapiens
ccaccagccccttcttcttgtgaaggaaatcc

SEQ ID NO: 5819 - DNA, 32 bp, Homo sapiens
tcctcgggcctctcttcgtcgaagagtctcct

SEQ ID NO: 5820 - DNA, 32 bp, Homo sapiens
ctctgtcatccaggctagagtgcagtggcacg

SEQ ID NO: 5821 - DNA, 32 bp, Homo sapiens
cctgtcagcctctttcccatagctaatagaca

SEQ ID NO: 5822 - DNA, 32 bp, Homo sapiens
gttccagcagaactggactaattctgtggacc

SEQ ID NO: 5823 - DNA, 32 bp, Homo sapiens
ctactcgggaggctaaggcaggggaatcgctt

SEQ ID NO: 5824 - DNA, 32 bp, Homo sapiens
cactcatcaaaccacatcttgatgctaagtaa

SEQ ID NO: 5825 - DNA, 32 bp, Homo sapiens
tgaatccacatcctgaagggaggctacaactg

SEQ ID NO: 5826 - DNA, 32 bp, Homo sapiens
tgagccaggaggttgaggttgcagtgagctga

SEQ ID NO: 5827 - DNA, 32 bp, Homo sapiens
ctactcgggaggctgaggcaagagaatcactt

SEQ ID NO: 5828 - DNA, 32 bp, Homo sapiens
ctattcgggaggctgaggcaggagaattgctt

SEQ ID NO: 5829 - DNA, 32 bp, Homo sapiens
agctctgcctcctgggttcaagcgattcccct

SEQ ID NO: 5830 - DNA, 32 bp, Homo sapiens
ctactcgggaggctgaggcaggagaatcgctt

SEQ ID NO: 5831 - DNA, 32 bp, Homo sapiens
gaatccaggaggaggaggttgcagtgagccga

SEQ ID NO: 5832 - DNA, 32 bp, Homo sapiens
cctttctggtcctgctgctccctatgggatgt

SEQ ID NO: 5833 - DNA, 32 bp, Homo sapiens
cccagacacgacgacttcgctcggaggcacat

SEQ ID NO: 5834 - DNA, 32 bp, Homo sapiens
acctccgcctcccgggttcaagtgattcttct

SEQ ID NO: 5835 - DNA, 32 bp, Homo sapiens
gcccaaggacctgggagctctgctccccactc

SEQ ID NO: 5836 - DNA, 32 bp, Homo sapiens
aactttactagtagctgagatttaatgggcac

SEQ ID NO: 5837 - DNA, 32 bp, Homo sapiens
caaaaccccacaatgagatactacctacacgg

SEQ ID NO: 5838 - DNA, 32 bp, Homo sapiens
gtttgcaatatttgttttaagcactttgaaac

SEQ ID NO: 5839 - DNA, 32 bp, Homo sapiens
ctccctgccctctgcactaagcactttccagg

SEQ ID NO: 5840 - DNA, 32 bp, Homo sapiens
gtcacctggttgcactatggcctcatctgtgg

SEQ ID NO: 5841 - DNA, 32 bp, Homo sapiens
ggagttggaagaggagggattagaaacaggag

SEQ ID NO: 5842 - DNA, 32 bp, Homo sapiens
aatggaggaagaggaagtaggaagaatgcagg

SEQ ID NO: 5843 - DNA, 32 bp, Homo sapiens
ggctcactcctgtaatcccagcactttgggaa

SEQ ID NO: 5844 - DNA, 32 bp, Homo sapiens
aacttggcctgagaacattttctgggaagagg

SEQ ID NO: 5845 - DNA, 32 bp, Homo sapiens
gctctgtcgccaggctggagtgcagtggtgcg

SEQ ID NO: 5846 - DNA, 32 bp, Homo sapiens
gcgagcagcgtggagctcagtgacagcagcag

SEQ ID NO: 5847 - DNA, 32 bp, Homo sapiens
gtagagatggggtcttgctttgttgcccaggt

SEQ ID NO: 5848 - DNA, 22 bp, Homo sapiens
gcgtgatctctactcactgcag

SEQ ID NO: 5849 - DNA, 21 bp, Homo sapiens
ggcaaatggcccagctctgcc

SEQ ID NO: 5850 - DNA, 22 bp, Homo sapiens
cccaaccagccggacctcagca

SEQ ID NO: 5851 - DNA, 16 bp, Homo sapiens
agggaagtctccgccc

SEQ ID NO: 5852 - DNA, 32 bp, Homo sapiens
ttgagatggagtttcactcttgttgcccacgc

SEQ ID NO: 5853 - DNA, 32 bp, Homo sapiens
ctgcatgaacaacaggtaaataaattttagat

SEQ ID NO: 5854 - DNA, 32 bp, Homo sapiens
tgtggaagtgagaaggagtcactgtgatgctt

SEQ ID NO: 5855 - DNA, 32 bp, Homo sapiens
aactttgtagaacttaaatacttgaatattca

SEQ ID NO: 5856 - DNA, 32 bp, Homo sapiens
cactttgggaggcaaaggcaggtggatcacct

SEQ ID NO: 5857 - DNA, 32 bp, Homo sapiens
gtatgctggaggcagagggcaagggaggggtg

SEQ ID NO: 5858 - DNA, 32 bp, Homo sapiens
ctcagtcgctcaggctggagtgcagtggcgcg

SEQ ID NO: 5859 - DNA, 32 bp, Homo sapiens
gaatctgggaggcagaggttgcagtgagctga

SEQ ID NO: 5860 - DNA, 32 bp, Homo sapiens
aagcccaggagacagaggttgcagtgagccaa

SEQ ID NO: 5861 - DNA, 32 bp, Homo sapiens
gagcccaggaggcggaggttgcagtgagctga

SEQ ID NO: 5862 - DNA, 32 bp, Homo sapiens
agcctcctgagtagctggaattacaggcaccc

SEQ ID NO: 5863 - DNA, 32 bp, Homo sapiens
gttgaagggggcggcttcctggagccagcacc

SEQ ID NO: 5864 - DNA, 32 bp, Homo sapiens
agcctcctgagtagctgggattacagacaccc

SEQ ID NO: 5865 - DNA, 32 bp, Homo sapiens
agccttccgagtagctgggattacaggtgccc

SEQ ID NO: 5866 - DNA, 32 bp, Homo sapiens
agcctcctgaatagctgggattacaggcaccc

SEQ ID NO: 5867 - DNA, 32 bp, Homo sapiens
ccaggttcacgccattctcccgcctcaacctc

SEQ ID NO: 5868 - DNA, 32 bp, Homo sapiens
agatactacctgcaattttatacatgtatttt

SEQ ID NO: 5869 - DNA, 32 bp, Homo sapiens
gatgaaggtaatccggagtggcaatggagtgg

SEQ ID NO: 5870 - DNA, 32 bp, Homo sapiens
taatctcattggaggagggaactgtttcctgc

SEQ ID NO: 5871 - DNA, 24 bp, Homo sapiens
tcaagcctgtaatcccaacacttt

SEQ ID NO: 5872 - DNA, 24 bp, Homo sapiens
ctagtttggaataaaaattgcaga

SEQ ID NO: 5873 - DNA, 32 bp, Homo sapiens
ttatcagccctctcttttcttatattaaacag

SEQ ID NO: 5874 - DNA, 32 bp, Homo sapiens
cccctcccggaggcagcttcaggacaggacac

SEQ ID NO: 5875 - DNA, 22 bp, Homo sapiens
tattcttgaagcactccaccca

SEQ ID NO: 5876 - DNA, 32 bp, Homo sapiens
ggagaagcctccactccattgtctcctggccc

SEQ ID NO: 5877 - DNA, 32 bp, Homo sapiens
tgacaagaggagagatatgcactgtgatatta

SEQ ID NO: 5878 - DNA, 23 bp, Homo sapiens
tggcattatctcagctcactgca

SEQ ID NO: 5879 - DNA, 32 bp, Homo sapiens
tcttgttccccaggctggagtgcaatggcacg

SEQ ID NO: 5880 - DNA, 24 bp, Homo sapiens
gcctggacctccctgcgatttccc

SEQ ID NO: 5881 - DNA, 32 bp, Homo sapiens
tgccaactctctgcattccctgatctccatcc

SEQ ID NO: 5882 - DNA, 32 bp, Homo sapiens
gaacccaggaggcagagattgcggtgagccgg

SEQ ID NO: 5883 - DNA, 32 bp, Homo sapiens
ttgccttggaggcagaagctgtgagtttcaga

SEQ ID NO: 5884 - DNA, 32 bp, Homo sapiens
tcttgttgcccaggctggagtgcaatggcacc

SEQ ID NO: 5885 - DNA, 32 bp, Homo sapiens
gcaggactccggcactatgagcggcttcagca

SEQ ID NO: 5886 - DNA, 32 bp, Homo sapiens
cttgggtgtgacacctgcttgacagaggcagg

SEQ ID NO: 5887 - DNA, 24 bp, Homo sapiens
tcatgcctatattcccagcacttt

SEQ ID NO: 5888 - DNA, 32 bp, Homo sapiens
gggagcaggttagagggacaaagagctttgca

SEQ ID NO: 5889 - DNA, 32 bp, Homo sapiens
ctgacctcaggtgatgcacccacctcagcctc

SEQ ID NO: 5890 - DNA, 32 bp, Homo sapiens
agccagcctcaaggagacatctggtttaggcc

SEQ ID NO: 5891 - DNA, 32 bp, Homo sapiens
agcaagactttataattccttctgcctaactt

SEQ ID NO: 5892 - DNA, 24 bp, Homo sapiens
tcaagcctataatcccagcacttt

SEQ ID NO: 5893 - DNA, 32 bp, Homo sapiens
tttggatggagtttcgttttgtcgcccaggct

SEQ ID NO: 5894 - DNA, 23 bp, Homo sapiens
tggcacaaccttggctcactgca

SEQ ID NO: 5895 - DNA, 32 bp, Homo sapiens
ccctgtcacccaggctggagtgcagtggcacg

SEQ ID NO: 5896 - DNA, 32 bp, Homo sapiens
gaccccaggaggcgaagattgcagtgagctga

SEQ ID NO: 5897 - DNA, 32 bp, Homo sapiens
gtctgttgcctaggcgggagtgcagtggcatc

SEQ ID NO: 5898 - DNA, 32 bp, Homo sapiens
cgggcgtcttggttgaatcttttgctacaaac

SEQ ID NO: 5899 - DNA, 28 bp, Homo sapiens
tgtggttcaagtgcttccttccccatca

SEQ ID NO: 5900 - DNA, 28 bp, Homo sapiens
ccgaccgcccgtgctgcctccttccggg

SEQ ID NO: 5901 - DNA, 32 bp, Homo sapiens
agtggtgggaggcagctgtggtgcaggagctg

SEQ ID NO: 5902 - DNA, 32 bp, Homo sapiens
ttggatcaagacgatccaggagagcagcaacc

SEQ ID NO: 5903 - DNA, 32 bp, Homo sapiens
gaacaagagggaggagaaagtgagaagcagcg

SEQ ID NO: 5904 - DNA, 32 bp, Homo sapiens
ctgggctcaagcaatcctctcacctcagcctc

SEQ ID NO: 5905 - DNA, 32 bp, Homo sapiens
ctggactcaagtgatcctcccacctcagcctc

SEQ ID NO: 5906 - DNA, 32 bp, Homo sapiens
tgccactgtctgggccccatctgggattcctg

SEQ ID NO: 5907 - DNA, 32 bp, Homo sapiens
ggatattattggagacggggtttcactgtgtt

SEQ ID NO: 5908 - DNA, 32 bp, Homo sapiens
ggaatctctgtaggctcacctttgccatttct

SEQ ID NO: 5909 - DNA, 32 bp, Homo sapiens
cactgccctcaaggctgcttgaggctcccacg

SEQ ID NO: 5910 - DNA, 32 bp, Homo sapiens
tgcgcctgtcttctccctctgaccccagagaa

SEQ ID NO: 5911 - DNA, 32 bp, Homo sapiens
aaactcttcttcttccccatcaggaccatttt

SEQ ID NO: 5912 - DNA, 32 bp, Homo sapiens
ttctccagagcctccagataagaggccaggct

SEQ ID NO: 5913 - DNA, 32 bp, Homo sapiens
accctagcctgaggctccactggaagatctcg

SEQ ID NO: 5914 - DNA, 32 bp, Homo sapiens
ctgggtgcctgaagctatagtgcaatggttcc

SEQ ID NO: 5915 - DNA, 32 bp, Homo sapiens
ttcttgttgcccaggctggaatgcaatggcgc

SEQ ID NO: 5916 - DNA, 18 bp, Homo sapiens
gcaggagcctgcaggaga

SEQ ID NO: 5917 - DNA, 32 bp, Homo sapiens
caataaacctaaccttttaacagggtctaaca

SEQ ID NO: 5918 - DNA, 32 bp, Homo sapiens
cagcaatgtttccttcaactctggcagttccc

SEQ ID NO: 5919 - DNA, 32 bp, Homo sapiens
gctccatcgcccaggcctgggatgcagtgatg

SEQ ID NO: 5920 - DNA, 32 bp, Homo sapiens
gctctgtcacccaggctggagtgcagtagcat

SEQ ID NO: 5921 - DNA, 32 bp, Homo sapiens
ctctgtcacccaggctggagtgcagtggccca

SEQ ID NO: 5922 - DNA, 32 bp, Homo sapiens
tgtgcgtgtgtccatgtgtgtgcagtgtgtgc

SEQ ID NO: 5923 - DNA, 32 bp, Homo sapiens
cagctgatccggactggatgtgaccttctgcc

SEQ ID NO: 5924 - DNA, 32 bp, Homo sapiens
gaacccggaaggtggaggttgcagtgagccga

SEQ ID NO: 5925 - DNA, 32 bp, Homo sapiens
gaacccaggaggcagagggttgcagtgagccg

SEQ ID NO: 5926 - DNA, 32 bp, Homo sapiens
agagactgtagctcagggcgtgcaatgtgagg

SEQ ID NO: 5927 - DNA, 28 bp, Homo sapiens
gccccagcccagcctgcctcatcccacc

SEQ ID NO: 5928 - DNA, 32 bp, Homo sapiens
gaacccaggagacaggggttgcagtgagccaa

SEQ ID NO: 5929 - DNA, 32 bp, Homo sapiens
gaacctgggaggtggaagttgcagtgagctga

SEQ ID NO: 5930 - DNA, 32 bp, Homo sapiens
aggaggagaggtggatggcaatgtgattggtg

SEQ ID NO: 5931 - DNA, 32 bp, Homo sapiens
agctctctcatctcctggaaccatggccagca

SEQ ID NO: 5932 - DNA, 32 bp, Homo sapiens
ccaggctcaagtgatcctcccacctcagcccc

SEQ ID NO: 5933 - DNA, 32 bp, Homo sapiens
caccgccacctgcacctgggccttttccccaa

SEQ ID NO: 5934 - DNA, 32 bp, Homo sapiens
caagctccttggtcttcttgccaagcaggaag

SEQ ID NO: 5935 - DNA, 23 bp, Homo sapiens
tgaaagaaaaagaacacttgctc

SEQ ID NO: 5936 - DNA, 32 bp, Homo sapiens
gcaattcctcaaggatctagaaccagaaatac

SEQ ID NO: 5937 - DNA, 23 bp, Homo sapiens
tggcacgatctcggctcacggca

SEQ ID NO: 5938 - DNA, 32 bp, Homo sapiens
gatgtcctgttttcaccagaggcacagcgcga

SEQ ID NO: 5939 - DNA, 32 bp, Homo sapiens
ggcattcacgtcccttcttgcagggcatttta

SEQ ID NO: 5940 - DNA, 32 bp, Homo sapiens
aaagtggccatcctgaaacctagtgttgctgt

SEQ ID NO: 5941 - DNA, 32 bp, Homo sapiens
ggaggacaacactgcctttcaaactttttact

SEQ ID NO: 5942 - DNA, 32 bp, Homo sapiens
gctcaatttcttaggctggagtgcagtggcac

SEQ ID NO: 5943 - DNA, 32 bp, Homo sapiens
agaggttgcagtgagctgagatcatgtttctg

SEQ ID NO: 5944 - DNA, 32 bp, Homo sapiens
aagcccgggaggcagaacctgcagtgagccaa

SEQ ID NO: 5945 - DNA, 32 bp, Homo sapiens
ctttgtcacccaggctagagtgcagtggtgca

SEQ ID NO: 5946 - DNA, 32 bp, Homo sapiens
caccaggattgagacttcctgtgggcaccaaa

SEQ ID NO: 5947 - DNA, 32 bp, Homo sapiens
actgctcatagataacaactggaacattataa

SEQ ID NO: 5948 - DNA, 32 bp, Homo sapiens
ctcggttcaagcaattcgcccaccttggcctc

SEQ ID NO: 5949 - DNA, 32 bp, Homo sapiens
ggcaaatgcctgtaatcccagcactttgggag

SEQ ID NO: 5950 - DNA, 32 bp, Homo sapiens
tgtaacctaggagcaggaaacttcagcttaac

SEQ ID NO: 5951 - DNA, 32 bp, Homo sapiens
tgttgcctgtgaggagctttctggcatgtgat

SEQ ID NO: 5952 - DNA, 31 bp, Homo sapiens
gaggaagacaacacaacacaggaggggataa

SEQ ID NO: 5953 - DNA, 21 bp, Homo sapiens
caaaatgaaagtaatggagaa

SEQ ID NO: 5954 - DNA, 32 bp, Homo sapiens
tttcagtgcccaggaagaaggcagctgggaca

SEQ ID NO: 5955 - DNA, 32 bp, Homo sapiens
actttgtcgcccaggctggagtacagtggtgc

SEQ ID NO: 5956 - DNA, 32 bp, Homo sapiens
gctgtgctgctgctggtctcctgatggctgtt

SEQ ID NO: 5957 - DNA, 32 bp, Homo sapiens
cgggcctctgggcagaggatgcaatggcacgg

SEQ ID NO: 5958 - DNA, 32 bp, Homo sapiens
gagttttaaattatttatgtgcctgttgcttc

SEQ ID NO: 5959 - DNA, 32 bp, Homo sapiens
ctcagaggtttaggctggaggcttggtgagaa

SEQ ID NO: 5960 - DNA, 32 bp, Homo sapiens
accctgtcctccacctgccttccattttgaag

SEQ ID NO: 5961 - DNA, 32 bp, Homo sapiens
gcgcccggaaggcccctgctgtggagaagccg

SEQ ID NO: 5962 - DNA, 32 bp, Homo sapiens
tacttctcaacaacatcaactatgtaaaatga

SEQ ID NO: 5963 - DNA, 32 bp, Homo sapiens
aaaattcaacatcacttcaagttaaagacact

SEQ ID NO: 5964 - DNA, 32 bp, Homo sapiens
agcctcccgagtagctgggattacaggcacac

SEQ ID NO: 5965 - DNA, 32 bp, Homo sapiens
agcctcctgagtagctgggattataggcacac

SEQ ID NO: 5966 - DNA, 32 bp, Homo sapiens
taccggaagaagtgaaacgtgtggaaaatgcc

SEQ ID NO: 5967 - DNA, 32 bp, Homo sapiens
cacaatacagtactcaggcagtgcagtactca

SEQ ID NO: 5968 - DNA, 32 bp, Homo sapiens
attctgtcacccaggctagagcgcagtggcaa

SEQ ID NO: 5969 - DNA, 32 bp, Homo sapiens
agcctcctgagtagctgggattacaggcacat

SEQ ID NO: 5970 - DNA, 32 bp, Homo sapiens
acaggctggggaggagaaaacaaacacatcaa

SEQ ID NO: 5971 - DNA, 32 bp, Homo sapiens
gttatagcaggaggagaaaaacaagccatttt

SEQ ID NO: 5972 - DNA, 32 bp, Homo sapiens
tggctgaggttagtgtgcttggaggctgcagg

SEQ ID NO: 5973 - DNA, 24 bp, Homo sapiens
tcacgcctgtaatcccagtacttt

SEQ ID NO: 5974 - DNA, 23 bp, Homo sapiens
tgtgcctgtaatctcagcacttt

SEQ ID NO: 5975 - DNA, 23 bp, Homo sapiens
tcacacctgtaatcccagcactt

SEQ ID NO: 5976 - DNA, 23 bp, Homo sapiens
tggcacgatcttggctcactgca

SEQ ID NO: 5977 - DNA, 19 bp, Homo sapiens
gccatcgcccagcccagaa

SEQ ID NO: 5978 - DNA, 32 bp, Homo sapiens
ctctgttgcccaggctgcagtgcagtggtgtg

SEQ ID NO: 5979 - DNA, 23 bp, Homo sapiens
tggcgcgatctcagctcaccgca

SEQ ID NO: 5980 - DNA, 23 bp, Homo sapiens
tggcgcgatcttagctcactgca

SEQ ID NO: 5981 - DNA, 23 bp, Homo sapiens
tggtgcgatctcagctcactgca

SEQ ID NO: 5982 - DNA, 32 bp, Homo sapiens
ttcccctctgctactagccactgagaagtgca

SEQ ID NO: 5983 - DNA, 23 bp, Homo sapiens
tggcacgatctcggctcaccgca

SEQ ID NO: 5984 - DNA, 23 bp, Homo sapiens
tggcacgatcttagctcactaca

SEQ ID NO: 5985 - DNA, 32 bp, Homo sapiens
caggctcacccaggctggggtctgagtgtcac

SEQ ID NO: 5986 - DNA, 32 bp, Homo sapiens
cagtgctagttctgacccaaccacagaggatg

SEQ ID NO: 5987 - DNA, 32 bp, Homo sapiens
tttgccccagttctgggcagccacaggccccc

SEQ ID NO: 5988 - DNA, 32 bp, Homo sapiens
gaacctgggaggcagaggttgtagcgagccaa

SEQ ID NO: 5989 - DNA, 32 bp, Homo sapiens
cactgttgcccaggctggagtgcattgatgtg

SEQ ID NO: 5990 - DNA, 32 bp, Homo sapiens
caagccgctaccctgaatctttgtggcgggtt

SEQ ID NO: 5991 - DNA, 32 bp, Homo sapiens
aacctcttcctcctggttcaagcgattctcat

SEQ ID NO: 5992 - DNA, 28 bp, Homo sapiens
tccagctatgtggctgcctcttctgctg

SEQ ID NO: 5993 - DNA, 32 bp, Homo sapiens
gggcacccaagtgccccctgtctgcgaagtcc

SEQ ID NO: 5994 - DNA, 32 bp, Homo sapiens
gcctctgcctcctgggttcaagcgattctcct

SEQ ID NO: 5995 - DNA, 32 bp, Homo sapiens
cgctcatgcctgtggtcccagcactttgggag

SEQ ID NO: 5996 - DNA, 32 bp, Homo sapiens
tgttggaagaattccttgattggaaattgtac

SEQ ID NO: 5997 - DNA, 32 bp, Homo sapiens
atggggacttcctgggacaagcaaggaaagta

SEQ ID NO: 5998 - DNA, 22 bp, Homo sapiens
tcatgcctgtagtcccagcact

SEQ ID NO: 5999 - DNA, 24 bp, Homo sapiens
tcatgcctgtaatccccgcacttt

SEQ ID NO: 6000 - DNA, 32 bp, Homo sapiens
ggcacggcaagaggagcaagagcaaggaccgc

SEQ ID NO: 6001 - DNA, 32 bp, Homo sapiens
tcggcctctgcagtcccaacgtctgcctcaca

SEQ ID NO: 6002 - DNA, 32 bp, Homo sapiens
ttgtcccagcttctcccctgggggcctgagag

SEQ ID NO: 6003 - DNA, 32 bp, Homo sapiens
aatttccaacttctccctatcttcaactctgc

SEQ ID NO: 6004 - DNA, 32 bp, Homo sapiens
ccatgtcctgagtctgcttcagtctggagctg

SEQ ID NO: 6005 - DNA, 32 bp, Homo sapiens
ttgtgccttttaggagctttatgtttagaaac

SEQ ID NO: 6006 - DNA, 24 bp, Homo sapiens
ctgtcatccaggctggagtgcagt

SEQ ID NO: 6007 - DNA, 32 bp, Homo sapiens
ccctctctgctgctgtttccatggcccagcat

SEQ ID NO: 6008 - DNA, 21 bp, Homo sapiens
ggacccctcacaaacacactt

SEQ ID NO: 6009 - DNA, 32 bp, Homo sapiens
ctcttcctccaaggctggagtgcagtgacgcg

SEQ ID NO: 6010 - DNA, 20 bp, Homo sapiens
agcaaagacattctgctcag

SEQ ID NO: 6011 - DNA, 32 bp, Homo sapiens
actgtgtcacccaggctggagtgcagtggcac

SEQ ID NO: 6012 - DNA, 32 bp, Homo sapiens
taatttagtcaacttgaaaatttcggtagtct

SEQ ID NO: 6013 - DNA, 32 bp, Homo sapiens
tcctatctggatgggtattgatcatgtccaac

SEQ ID NO: 6014 - DNA, 32 bp, Homo sapiens
gaacctggaaggcggaggttgcagtgagcaga

SEQ ID NO: 6015 - DNA, 32 bp, Homo sapiens
gaacccaggaggtggaggttgcaagtgagctg

SEQ ID NO: 6016 - DNA, 32 bp, Homo sapiens
acctctacctcctgggttcaagggattctcct

SEQ ID NO: 6017 - DNA, 28 bp, Homo sapiens
ggcggcccaagtggagctcacctctccc

SEQ ID NO: 6018 - DNA, 32 bp, Homo sapiens
ccccggccagggtcccttaacacctcggcaca

SEQ ID NO: 6019 - DNA, 32 bp, Homo sapiens
ctgacttcaagcaattctcctgcctcagcctc

SEQ ID NO: 6020 - DNA, 32 bp, Homo sapiens
ataagtaggcctggagcctcagcttctgtaaa

SEQ ID NO: 6021 - DNA, 32 bp, Homo sapiens
agcggccccaaaattcccaccttgatttccat

SEQ ID NO: 6022 - DNA, 32 bp, Homo sapiens
tgcccgcatcttctgttccatgggtgcccagc

SEQ ID NO: 6023 - DNA, 32 bp, Homo sapiens
attattcgtcttctccccattccgctgccgcc

SEQ ID NO: 6024 - DNA, 21 bp, Homo sapiens
gggcctccagaactcctgttt

SEQ ID NO: 6025 - DNA, 32 bp, Homo sapiens
acgcccctgccctggccgcacagggttgggtt

SEQ ID NO: 6026 - DNA, 32 bp, Homo sapiens
atatgtctattccaggattcagtctagaaact

SEQ ID NO: 6027 - DNA, 32 bp, Homo sapiens
ggatggtctctgctgctcttgcctctagttca

SEQ ID NO: 6028 - DNA, 32 bp, Homo sapiens
acaggtgtgctgcgcgggaagccccatgctcc

SEQ ID NO: 6029 - DNA, 32 bp, Homo sapiens
cctgtgttgctgctgctgaggccaaatcactc

SEQ ID NO: 6030 - DNA, 32 bp, Homo sapiens
gctgtgtcgcccaggctggagtgcagtgagct

SEQ ID NO: 6031 - DNA, 32 bp, Homo sapiens
gctctgtcacccaggcaggagtgcagtggcac

SEQ ID NO: 6032 - DNA, 32 bp, Homo sapiens
attgtcctgtctagtttgaatatttcaagaac

SEQ ID NO: 6033 - DNA, 32 bp, Homo sapiens
agaaaggatactgtcggttcactgttgagcag

SEQ ID NO: 6034 - DNA, 32 bp, Homo sapiens
gctctgtctcccaggctggagtgcagtggcac

SEQ ID NO: 6035 - DNA, 32 bp, Homo sapiens
cctctgtcacctaggctggagtgcagtggcac

SEQ ID NO: 6036 - DNA, 32 bp, Homo sapiens
ctcttgggaagaccagctttgcagtgacagct

SEQ ID NO: 6037 - DNA, 32 bp, Homo sapiens
aaaccaagcccaggccgggggcggtggctcac

SEQ ID NO: 6038 - DNA, 32 bp, Homo sapiens
tctgcggcccggggctggagcgcagcgggaag

SEQ ID NO: 6039 - DNA, 32 bp, Homo sapiens
gaacccgggaggcggaggttacagtgagctga

SEQ ID NO: 6040 - DNA, 32 bp, Homo sapiens
gaacccaggaggcagaggttgcgttgagccaa

SEQ ID NO: 6041 - DNA, 32 bp, Homo sapiens
gaacccaggaggcagtggttgcaatgagccga

SEQ ID NO: 6042 - DNA, 32 bp, Homo sapiens
taaccaccaactgcccttattccggctgggac

SEQ ID NO: 6043 - DNA, 32 bp, Homo sapiens
aagaggccctgggccgaggtgcagtgaccctg

SEQ ID NO: 6044 - DNA, 32 bp, Homo sapiens
gaatctaagaagcagaggttgcagtgagctga

SEQ ID NO: 6045 - DNA, 32 bp, Homo sapiens
cttcacacagtattctcccccacgccgtctat

SEQ ID NO: 6046 - DNA, 32 bp, Homo sapiens
acctccgcctcccgagttcaagcgattctcct

SEQ ID NO: 6047 - DNA, 32 bp, Homo sapiens
acctccgcctcctgggttcaagcaattctctg

SEQ ID NO: 6048 - DNA, 32 bp, Homo sapiens
ctgtgctcaagccatcctcccaccttagcctc

SEQ ID NO: 6049 - DNA, 32 bp, Homo sapiens
ggctcttgcctgtaatcccagcactttgatag

SEQ ID NO: 6050 - DNA, 32 bp, Homo sapiens
gggaggcggcctggggagcccccaacttatgc

SEQ ID NO: 6051 - DNA, 32 bp, Homo sapiens
ccagagtcacccagttggtgactgggaaagtt

SEQ ID NO: 6052 - DNA, 32 bp, Homo sapiens
gctctgtcgcccagactggagtgcaatggtgc

SEQ ID NO: 6053 - DNA, 32 bp, Homo sapiens
ctcttgtcacccaggctggagtgcaatggcac

SEQ ID NO: 6054 - DNA, 20 bp, Homo sapiens
tcatgcctataatcagcact

SEQ ID NO: 6055 - DNA, 32 bp, Homo sapiens
agaagaggaagaggaagaggaagagaggaagc

SEQ ID NO: 6056 - DNA, 32 bp, Homo sapiens
ttccctgagaaaggagaaaaagatgggattgc

SEQ ID NO: 6057 - DNA, 32 bp, Homo sapiens
gtaggagtgctaccatggaaatggacagagtt

SEQ ID NO: 6058 - DNA, 19 bp, Homo sapiens
gcccctgcccagtgaacag

SEQ ID NO: 6059 - DNA, 22 bp, Homo sapiens
tcatgtgtgtaatcccagcact

SEQ ID NO: 6060 - DNA, 21 bp, Homo sapiens
ccgtggccactggagacctca

SEQ ID NO: 6061 - DNA, 32 bp, Homo sapiens
tctctaactcttatcttccacagggtccaaga

SEQ ID NO: 6062 - DNA, 32 bp, Homo sapiens
cctgatcctcaaggaacttgcaaatgtgtcta

SEQ ID NO: 6063 - DNA, 32 bp, Homo sapiens
atagtcaacatcttgaactatatttcaaatga

SEQ ID NO: 6064 - DNA, 32 bp, Homo sapiens
ggggccaaggcaaaggggaagcattcacagac

SEQ ID NO: 6065 - DNA, 32 bp, Homo sapiens
aatgccacaaagttgtggaatttttgtgatta

SEQ ID NO: 6066 - DNA, 32 bp, Homo sapiens
tggagggccaggcagaggctgttctggaaggc

SEQ ID NO: 6067 - DNA, 32 bp, Homo sapiens
aagaggaaagagaagagatcgctcaggggtga

SEQ ID NO: 6068 - DNA, 32 bp, Homo sapiens
ccctgcccctctctgtcatagctaacaggaat

SEQ ID NO: 6069 - DNA, 32 bp, Homo sapiens
acctccacctcccgggttcaagcgattctcct

SEQ ID NO: 6070 - DNA, 28 bp, Homo sapiens
gatttcccaagtgctttaccttatctgt

SEQ ID NO: 6071 - DNA, 32 bp, Homo sapiens
gagcccaggaggcggaggctgcagtgagctga

SEQ ID NO: 6072 - DNA, 32 bp, Homo sapiens
gcctcccgggcacttctccccacctcggcccc

SEQ ID NO: 6073 - DNA, 32 bp, Homo sapiens
cagtctcctggtagctgggattacaggcatgc

SEQ ID NO: 6074 - DNA, 32 bp, Homo sapiens
aaggagcagtgcgctaagctgtggaaaattcc

SEQ ID NO: 6075 - DNA, 32 bp, Homo sapiens
aggaattaaaatatctgtagaagccatggctt

SEQ ID NO: 6076 - DNA, 32 bp, Homo sapiens
agagaaggaagaggaaagcaaaggagtcaggg

SEQ ID NO: 6077 - DNA, 32 bp, Homo sapiens
cgattcctcgccagctgggagtgcagaagtct

SEQ ID NO: 6078 - DNA, 32 bp, Homo sapiens
ttctttatgtgtttcattacagctccaaaaag

SEQ ID NO: 6079 - DNA, 32 bp, Homo sapiens
atcattcatcccttaacaggcacattagatct

SEQ ID NO: 6080 - DNA, 32 bp, Homo sapiens
ctgttggctttctcttctgcagcaacaggtca

SEQ ID NO: 6081 - DNA, 32 bp, Homo sapiens
tggatgacttggagatttatctctgtttcctt

SEQ ID NO: 6082 - DNA, 32 bp, Homo sapiens
tttagacggagttttgctcttgttgcccaggc

SEQ ID NO: 6083 - DNA, 32 bp, Homo sapiens
ccaggggtgctgctgcctaagccacccacata

SEQ ID NO: 6084 - DNA, 32 bp, Homo sapiens
tagaggaaagagaacccttgtacactgttggt

SEQ ID NO: 6085 - DNA, 32 bp, Homo sapiens
gctctgttacccaggctggagtgcagtgggtg

SEQ ID NO: 6086 - DNA, 32 bp, Homo sapiens
actcttccgcccaggctgcagtgcagtggcat

SEQ ID NO: 6087 - DNA, 32 bp, Homo sapiens
cagcatgatgttcttgtctttggagcttagcc

SEQ ID NO: 6088 - DNA, 32 bp, Homo sapiens
ctttcctgtctcctctcctctgatctgttctt

SEQ ID NO: 6089 - DNA, 32 bp, Homo sapiens
aggaggccctccattcctggtttctgtagctt

SEQ ID NO: 6090 - DNA, 32 bp, Homo sapiens
gaacccaggaggcagaggtcgcagtgagtcga

SEQ ID NO: 6091 - DNA, 32 bp, Homo sapiens
gtctcatgcccaggtgggtgctctgggctgga

SEQ ID NO: 6092 - DNA, 32 bp, Homo sapiens
tcttgttgcccaggccagagtgcaatggcgtg

SEQ ID NO: 6093 - DNA, 32 bp, Homo sapiens
cccagcccaagtgcctggcacacagctaatgt

SEQ ID NO: 6094 - DNA, 32 bp, Homo sapiens
gttttaccaagtgctgtcttgatgactgctga

SEQ ID NO: 6095 - DNA, 32 bp, Homo sapiens
gaacccgggaagcggaggttgcagtgagccga

SEQ ID NO: 6096 - DNA, 28 bp, Homo sapiens
cctcacccaagtggcggcatcttacggc

SEQ ID NO: 6097 - DNA, 28 bp, Homo sapiens
tctatctcatttgctgccttttcactaa

SEQ ID NO: 6098 - DNA, 28 bp, Homo sapiens
aatgtgttaagtgctgttcatttaagtt

SEQ ID NO: 6099 - DNA, 32 bp, Homo sapiens
tttgggtatttgcactattttgggagcaagtt

SEQ ID NO: 6100 - DNA, 32 bp, Homo sapiens
ccaagctctgagctctgctcccagggagcacg

SEQ ID NO: 6101 - DNA, 32 bp, Homo sapiens
tttcctattcaagacgtcctggaaaactacat

SEQ ID NO: 6102 - DNA, 32 bp, Homo sapiens
aaggctcatcagtctatccttctgcctccata

SEQ ID NO: 6103 - DNA, 32 bp, Homo sapiens
aatttatattggagaaaagcactgtaaatgta

SEQ ID NO: 6104 - DNA, 32 bp, Homo sapiens
gagctctcacccagagcgtcagtgagttggtg

SEQ ID NO: 6105 - DNA, 32 bp, Homo sapiens
ttgagacagaattttgctcttgttgcccaggc

SEQ ID NO: 6106 - DNA, 32 bp, Homo sapiens
gaaataggtctgctcctcacagctttgggaat

SEQ ID NO: 6107 - DNA, 32 bp, Homo sapiens
acatctgcctgagagatctccaagaattacag

SEQ ID NO: 6108 - DNA, 32 bp, Homo sapiens
tctctgttgcccaggctggagtgtagtggtgc

SEQ ID NO: 6109 - DNA, 32 bp, Homo sapiens
tcgcttgagcccaggcagttggagaccagtct

SEQ ID NO: 6110 - DNA, 32 bp, Homo sapiens
gggatgggagcgatgcttatctctcacagtgt

SEQ ID NO: 6111 - DNA, 32 bp, Homo sapiens
cgagtggcctgtgatggatggctggcctgtgg

SEQ ID NO: 6112 - DNA, 32 bp, Homo sapiens
attgcagcctccacttcctgggctcaagcgat

SEQ ID NO: 6113 - DNA, 32 bp, Homo sapiens
gctctgtcacccaggctggagtgctgtggtgc

SEQ ID NO: 6114 - DNA, 32 bp, Homo sapiens
aaaatttcatctaggctaggtgcagtggcttg

SEQ ID NO: 6115 - DNA, 32 bp, Homo sapiens
ctctgtcacccaggctggagtgcagtagcgcg

SEQ ID NO: 6116 - DNA, 32 bp, Homo sapiens
cttagctgggtgtggtggtgtgatctgtagtt

SEQ ID NO: 6117 - DNA, 32 bp, Homo sapiens
ctctgtcacccaggctggggtgcagtggcgcg

SEQ ID NO: 6118 - DNA, 32 bp, Homo sapiens
tggccatgcccagggctggtgttggttgagga

SEQ ID NO: 6119 - DNA, 32 bp, Homo sapiens
ctctgtcacccaggctggagtgcaatggtgcc

SEQ ID NO: 6120 - DNA, 28 bp, Homo sapiens
ctgctttcaagtgctggaacattaagtt

SEQ ID NO: 6121 - DNA, 32 bp, Homo sapiens
aggaagggagggcagagggggctgtggccgtc

SEQ ID NO: 6122 - DNA, 32 bp, Homo sapiens
ttctgtcgtccaggctggagtgcagtagcgca

SEQ ID NO: 6123 - DNA, 32 bp, Homo sapiens
agcctgctgagtagctgggactacaggcacat

SEQ ID NO: 6124 - DNA, 32 bp, Homo sapiens
agtgggaagacagtgccgctgttgagacaaga

SEQ ID NO: 6125 - DNA, 23 bp, Homo sapiens
agtggggagatttccactgtgga

SEQ ID NO: 6126 - DNA, 32 bp, Homo sapiens
ctttttaactgcactttctttatataatcgtt

SEQ ID NO: 6127 - DNA, 32 bp, Homo sapiens
ggctggaggcctgggagtcacaggtgcttgga

SEQ ID NO: 6128 - DNA, 32 bp, Homo sapiens
tgatgccatcttctcccccatccccttctctg

SEQ ID NO: 6129 - DNA, 22 bp, Homo sapiens
atctgtaatttccttgctctca

SEQ ID NO: 6130 - DNA, 32 bp, Homo sapiens
aaagggagtttccaggccagaagccatccctg

SEQ ID NO: 6131 - DNA, 32 bp, Homo sapiens
cagcccttaattagggcttcagtgacttagaa

SEQ ID NO: 6132 - DNA, 32 bp, Homo sapiens
tgtcattgtcttctccaccgggctgttcccat

SEQ ID NO: 6133 - DNA, 32 bp, Homo sapiens
atgaacctctgcttcttcatctggatcacact

SEQ ID NO: 6134 - DNA, 23 bp, Homo sapiens
tgacgagatcttggctcactgca

SEQ ID NO: 6135 - DNA, 32 bp, Homo sapiens
tccggggccctctctgcaccggacagtcggaa

SEQ ID NO: 6136 - DNA, 32 bp, Homo sapiens
cagccagcctgagctctcctgcaagacagagc

SEQ ID NO: 6137 - DNA, 32 bp, Homo sapiens
gggaaagcagaactgaagccacttggcccaga

SEQ ID NO: 6138 - DNA, 18 bp, Homo sapiens
gggtcacgcggcgggcac

SEQ ID NO: 6139 - DNA, 32 bp, Homo sapiens
ttgagatgaagtctccctcttgttacccaggc

SEQ ID NO: 6140 - DNA, 32 bp, Homo sapiens
actctgctgcccgggctagagtgcagtggtgg

SEQ ID NO: 6141 - DNA, 32 bp, Homo sapiens
ctcttgttgcccaggctggagtgcaatggagc

SEQ ID NO: 6142 - DNA, 32 bp, Homo sapiens
tggctaagaactcatggccactgtggaaatct

SEQ ID NO: 6143 - DNA, 32 bp, Homo sapiens
tcttctgaacaacttaggagaaacttttgatc

SEQ ID NO: 6144 - DNA, 32 bp, Homo sapiens
gggtagaaagagactctcgtgtggaggttaca

SEQ ID NO: 6145 - DNA, 32 bp, Homo sapiens
ctcttgtcacccaggctggagtgcagtagtgc

SEQ ID NO: 6146 - DNA, 32 bp, Homo sapiens
cttaccattttgctagggtgtgcaatgcccac

SEQ ID NO: 6147 - DNA, 32 bp, Homo sapiens
ccctgtctccgaggctggaatacggtggtgcg

SEQ ID NO: 6148 - DNA, 32 bp, Homo sapiens
tggactttgagtggaagatgtgatttggacca

SEQ ID NO: 6149 - DNA, 32 bp, Homo sapiens
gaacccgggcggtggagcttgcagtgagccga

SEQ ID NO: 6150 - DNA, 32 bp, Homo sapiens
ggacctgggaggtggaggttgcagtgagctga

SEQ ID NO: 6151 - DNA, 32 bp, Homo sapiens
ctctgtggcccaggctggagtgcagtggcatg

SEQ ID NO: 6152 - DNA, 28 bp, Homo sapiens
cccacgtcaggcctggcctcatctcaga

SEQ ID NO: 6153 - DNA, 32 bp, Homo sapiens
cccattccaagtgctctgccagcccctgttca

SEQ ID NO: 6154 - DNA, 32 bp, Homo sapiens
gaacccgggaggtggaggttgcagtaagccga

SEQ ID NO: 6155 - DNA, 32 bp, Homo sapiens
cttatggtagatggcttcctggaatcaaaatg

SEQ ID NO: 6156 - DNA, 32 bp, Homo sapiens
ctgcaggcactggggagctctgctggaattgg

SEQ ID NO: 6157 - DNA, 32 bp, Homo sapiens
agcctccccagtagctgggattacaggcaccc

SEQ ID NO: 6158 - DNA, 32 bp, Homo sapiens
tggtccctggcaacaggaacctgggcagctta

SEQ ID NO: 6159 - DNA, 32 bp, Homo sapiens
gaagtaagaagaggagcctcagaagaaaacaa

SEQ ID NO: 6160 - DNA, 32 bp, Homo sapiens
ccaggttcaagcaattctcccgcctcagcctc

SEQ ID NO: 6161 - DNA, 32 bp, Homo sapiens
ccaggttcaagcaattctcctgcctcagtctc

SEQ ID NO: 6162 - DNA, 24 bp, Homo sapiens
tcacgcctatgatcccagcacttt

SEQ ID NO: 6163 - DNA, 24 bp, Homo sapiens
tcacgcctgtgatcccggcacttt

SEQ ID NO: 6164 - DNA, 20 bp, Homo sapiens
ggcgccaccgtctccaagga

SEQ ID NO: 6165 - DNA, 32 bp, Homo sapiens
tgccaggacttgggaagcagtcactgtgaaat

SEQ ID NO: 6166 - DNA, 32 bp, Homo sapiens
ccattgcttgtttttctcaggtttgtcaaaga

SEQ ID NO: 6167 - DNA, 24 bp, Homo sapiens
tcacacctgtaatgccagcccttt

SEQ ID NO: 6168 - DNA, 19 bp, Homo sapiens
gaccacacaaacccagcct

SEQ ID NO: 6169 - DNA, 32 bp, Homo sapiens
ttctcttccgtttgcggttttctgcctaattg

SEQ ID NO: 6170 - DNA, 32 bp, Homo sapiens
cttctgcacttactccccatcagaagatcgag

SEQ ID NO: 6171 - DNA, 32 bp, Homo sapiens
ttgagatggagtttcactcttgtcacccaggc

SEQ ID NO: 6172 - DNA, 32 bp, Homo sapiens
tgtcctcatccctgcccagcaggctgcagaac

SEQ ID NO: 6173 - DNA, 32 bp, Homo sapiens
gacatacttgaccttgaaaaatctggggtcat

SEQ ID NO: 6174 - DNA, 32 bp, Homo sapiens
cactgtaatacagcttaaaatatttttagaat

SEQ ID NO: 6175 - DNA, 32 bp, Homo sapiens
cctttgttcagaaatggccactgtagaaagcc

SEQ ID NO: 6176 - DNA, 32 bp, Homo sapiens
ttgagacagagttttgctcttgtcacccaggc

SEQ ID NO: 6177 - DNA, 32 bp, Homo sapiens
gctctgttgcccaggctggagtgcactggctt

SEQ ID NO: 6178 - DNA, 32 bp, Homo sapiens
actctgttgcccaggatggaatgcagtggcac

SEQ ID NO: 6179 - DNA, 32 bp, Homo sapiens
ggtctgttgcccaggttggagtgcagtggcgg

SEQ ID NO: 6180 - DNA, 32 bp, Homo sapiens
gagctctggccaggctgtgccagtgtgtcccg

SEQ ID NO: 6181 - DNA, 32 bp, Homo sapiens
gctctgtcaccgaggctggagtgcagtggcgc

SEQ ID NO: 6182 - DNA, 32 bp, Homo sapiens
gctgtgtcacccaggctggagtgcagtggcgc

SEQ ID NO: 6183 - DNA, 32 bp, Homo sapiens
ctctgttgcccaggctagagtgcactaataca

SEQ ID NO: 6184 - DNA, 32 bp, Homo sapiens
aaagactgaagaggctggagtgcagtggcgca

SEQ ID NO: 6185 - DNA, 32 bp, Homo sapiens
agcccaagcccaggcattgcagtgcacagagc

SEQ ID NO: 6186 - DNA, 32 bp, Homo sapiens
ctgcagggagggcagaggcattgctgagactg

SEQ ID NO: 6187 - DNA, 32 bp, Homo sapiens
agttgaaggaggcagagaaggggttggtgata

SEQ ID NO: 6188 - DNA, 32 bp, Homo sapiens
tggagaaattcaggctgggtgcagtggctcac

SEQ ID NO: 6189 - DNA, 28 bp, Homo sapiens
cccagcgcacgggctgcctccatcaggg

SEQ ID NO: 6190 - DNA, 28 bp, Homo sapiens
cgcatttcaagtgctggatcctttttgt

SEQ ID NO: 6191 - DNA, 32 bp, Homo sapiens
gagccaggaaggttgaggttgcagtgagctat

SEQ ID NO: 6192 - DNA, 32 bp, Homo sapiens
agcctcctgagtagctgggaggacaggcatat

SEQ ID NO: 6193 - DNA, 32 bp, Homo sapiens
ggaggccaggccgagcccctggaaccatcccg

SEQ ID NO: 6194 - DNA, 32 bp, Homo sapiens
tacccgtcacccaagtggtagtagtctcttat

SEQ ID NO: 6195 - DNA, 32 bp, Homo sapiens
acactgtcgcccaatctggagtgcactggcgc

SEQ ID NO: 6196 - DNA, 32 bp, Homo sapiens
ctagcaagccacttcaggaaattcttttggag

SEQ ID NO: 6197 - DNA, 25 bp, Homo sapiens
tcagaactgtctctcctgggcccag

SEQ ID NO: 6198 - DNA, 32 bp, Homo sapiens
tcatcacccagtttttccctctggacccagga

SEQ ID NO: 6199 - DNA, 31 bp, Homo sapiens
tggctggagtggccaaataggagggagactg

SEQ ID NO: 6200 - DNA, 32 bp, Homo sapiens
actttgcctgcagcttctgctttcctgaaatt

SEQ ID NO: 6201 - DNA, 32 bp, Homo sapiens
tggactctcagccttgctgttctgcctggaga

SEQ ID NO: 6202 - DNA, 23 bp, Homo sapiens
tgtagagggaggagcgatgggga

SEQ ID NO: 6203 - DNA, 22 bp, Homo sapiens
gtcgcccaggctggagtgagtg

SEQ ID NO: 6204 - DNA, 32 bp, Homo sapiens
cagcaggccagaccagtctcccaggaggctga

SEQ ID NO: 6205 - DNA, 32 bp, Homo sapiens
attacttctcaaggattattagaatcttaggt

SEQ ID NO: 6206 - DNA, 32 bp, Homo sapiens
ttgagatggagtttctctcttgttgcccaggc

SEQ ID NO: 6207 - DNA, 32 bp, Homo sapiens
ggcctgtggtgactgcacacagctcgcaaaac

SEQ ID NO: 6208 - DNA, 32 bp, Homo sapiens
ctattgttccttttgtcacaggtaaaatcagt

SEQ ID NO: 6209 - DNA, 32 bp, Homo sapiens
aaagataaggtacaggaatgaaccttggttta

SEQ ID NO: 6210 - DNA, 32 bp, Homo sapiens
tgcctagccacactgtcatagacacagacatg

SEQ ID NO: 6211 - DNA, 32 bp, Homo sapiens
catattgcagaacagctctgagagcaacagtt

SEQ ID NO: 6212 - DNA, 32 bp, Homo sapiens
ttgtggaggttttgttggtgtgcaatggagga

SEQ ID NO: 6213 - DNA, 32 bp, Homo sapiens
ctctgttgtccaagctagagtgcagtgatacc

SEQ ID NO: 6214 - DNA, 32 bp, Homo sapiens
aaaaccaatgttctacaacttggaaagttttc

SEQ ID NO: 6215 - DNA, 28 bp, Homo sapiens
cccctcccaagtgaccctcctcctgcct

SEQ ID NO: 6216 - DNA, 32 bp, Homo sapiens
taggcgcggccagggccccacaacagcaggtc

SEQ ID NO: 6217 - DNA, 32 bp, Homo sapiens
tgaacctggaggcagagattgcagtgagccga

SEQ ID NO: 6218 - DNA, 32 bp, Homo sapiens
gggtctatgagtagctgtgtatgaataaatat

SEQ ID NO: 6219 - DNA, 32 bp, Homo sapiens
atattctgtaccacatacacttctgtggactt

SEQ ID NO: 6220 - DNA, 32 bp, Homo sapiens
ctggcctcaagcaatcctcccacctcagcatc

SEQ ID NO: 6221 - DNA, 32 bp, Homo sapiens
ggctcctgcctgtaatcgcagcactttgggag

SEQ ID NO: 6222 - DNA, 32 bp, Homo sapiens
ttccactgtcttccctggcagctgtgatgtgt

SEQ ID NO: 6223 - DNA, 21 bp, Homo sapiens
ggtgagggaactaaacctgtg

SEQ ID NO: 6224 - DNA, 32 bp, Homo sapiens
cggggctcaggtgattttcccacctcagcttt

SEQ ID NO: 6225 - DNA, 32 bp, Homo sapiens
ctggattcaagcaatcctcccatctcagcctc

SEQ ID NO: 6226 - DNA, 24 bp, Homo sapiens
ctgtcacccaggctgcagtgcaat

SEQ ID NO: 6227 - DNA, 32 bp, Homo sapiens
aggcatttgagtttgcctcttctgctttaatc

SEQ ID NO: 6228 - DNA, 32 bp, Homo sapiens
gttacccatcttctctactgtccccattctct

SEQ ID NO: 6229 - DNA, 32 bp, Homo sapiens
caagccgtgctgctgattccgtctcacagttt

SEQ ID NO: 6230 - DNA, 32 bp, Homo sapiens
gttccaagagccttttagtgattaaaatagaa

SEQ ID NO: 6231 - DNA, 32 bp, Homo sapiens
agaaaacccttcaaaagttcagtctagtctgg

SEQ ID NO: 6232 - DNA, 32 bp, Homo sapiens
aagctcaagcctttgcgaagctaatgacctgc

SEQ ID NO: 6233 - DNA, 23 bp, Homo sapiens
tggcatcatctcagctcactgca

SEQ ID NO: 6234 - DNA, 23 bp, Homo sapiens
tggcgtcatctcggctcactgca

SEQ ID NO: 6235 - DNA, 32 bp, Homo sapiens
gctctgtcacacaggctggagtgcagtggtgt

SEQ ID NO: 6236 - DNA, 32 bp, Homo sapiens
aactgcttgcccagggtgcagtgtgagtgtga

SEQ ID NO: 6237 - DNA, 32 bp, Homo sapiens
ccctctcgttccccgtcctcgtttccagcatc

SEQ ID NO: 6238 - DNA, 32 bp, Homo sapiens
gagcccaggaggtggaggttgcagtgagccaa

SEQ ID NO: 6239 - DNA, 32 bp, Homo sapiens
gaacctgggaggtggaggttgcagtgggctga

SEQ ID NO: 6240 - DNA, 32 bp, Homo sapiens
gaacttgggaggggtaggttgcagtgagctga

SEQ ID NO: 6241 - DNA, 32 bp, Homo sapiens
aggtcgttcctactgttttacaacagcatgtc

SEQ ID NO: 6242 - DNA, 32 bp, Homo sapiens
aacagtgttttagatgagagatcattaatgca

SEQ ID NO: 6243 - DNA, 32 bp, Homo sapiens
aaagtattggggtggaggttgcagtgagcgga

SEQ ID NO: 6244 - DNA, 32 bp, Homo sapiens
atgtgtctcacagtttgaaataagctatttga

SEQ ID NO: 6245 - DNA, 32 bp, Homo sapiens
acctccacctctcaggttcaagcaattctcat

SEQ ID NO: 6246 - DNA, 32 bp, Homo sapiens
ctggattcaagcaattctcctgcctcagcctc

SEQ ID NO: 6247 - DNA, 32 bp, Homo sapiens
tgcagctacctgcacttctagatgctccccag

SEQ ID NO: 6248 - DNA, 32 bp, Homo sapiens
ttatttgcttcaaaaggagatctttagaaaaa

SEQ ID NO: 6249 - DNA, 32 bp, Homo sapiens
ttgtggctggtctcctggtgtcagtgttctct

SEQ ID NO: 6250 - DNA, 32 bp, Homo sapiens
ttgaaacatcttccctgtgtccctgggggccc

SEQ ID NO: 6251 - DNA, 32 bp, Homo sapiens
gaaatgcatcttcttactgcatcagaccttcc

SEQ ID NO: 6252 - DNA, 32 bp, Homo sapiens
tattttcctaacctttcttctgggtccttcct

SEQ ID NO: 6253 - DNA, 19 bp, Homo sapiens
gctcaggctggagtgcagt

SEQ ID NO: 6254 - DNA, 32 bp, Homo sapiens
tcagaggcctctgcttctctcttgctcctaga

SEQ ID NO: 6255 - DNA, 32 bp, Homo sapiens
aagtgcaacattcactcgctgttttcattctt

SEQ ID NO: 6256 - DNA, 32 bp, Homo sapiens
ctccgtgagcaagatggcgactgtgaagagtg

SEQ ID NO: 6257 - DNA, 32 bp, Homo sapiens
aggcatctgctgctgctcctggctgccactca

SEQ ID NO: 6258 - DNA, 32 bp, Homo sapiens
ccttgcccctctctgtcatagctaacaggaat

SEQ ID NO: 6259 - DNA, 32 bp, Homo sapiens
gaccttccagttctgtctcctcagattgctgt

SEQ ID NO: 6260 - DNA, 32 bp, Homo sapiens
attcttgaaacttggctttccataacatggta

SEQ ID NO: 6261 - DNA, 32 bp, Homo sapiens
gggctttgcagggcggccagtgcagtgatgcc

SEQ ID NO: 6262 - DNA, 32 bp, Homo sapiens
cgctcgttacccagggtggagtgcagtggtag

SEQ ID NO: 6263 - DNA, 32 bp, Homo sapiens
acactgcagtccagtctggaccacagagtgag

SEQ ID NO: 6264 - DNA, 32 bp, Homo sapiens
tgaacctggaggtggaggttgcagtgagccga

SEQ ID NO: 6265 - DNA, 29 bp, Homo sapiens
tagtgttgcccaggctggagtgcagtggc

SEQ ID NO: 6266 - DNA, 32 bp, Homo sapiens
aagctacttgggacattattagcaataaaaat

SEQ ID NO: 6267 - DNA, 32 bp, Homo sapiens
ccctgcccaagtggctcttgggacaacgtgct

SEQ ID NO: 6268 - DNA, 32 bp, Homo sapiens
gagaccaggaggttgaggctgcagtgagccgt

SEQ ID NO: 6269 - DNA, 32 bp, Homo sapiens
ctactcgggaggctgagacaggagatttgctt

SEQ ID NO: 6270 - DNA, 32 bp, Homo sapiens
cgcctcccgagtagctgggattacaggcatgt

SEQ ID NO: 6271 - DNA, 32 bp, Homo sapiens
tatttcctaacaacagagagattctcttatgt

SEQ ID NO: 6272 - DNA, 32 bp, Homo sapiens
atctccgcctcctgggttcaaatgattctcct

SEQ ID NO: 6273 - DNA, 32 bp, Homo sapiens
tctctgtcatctgggctgcagtgcagtggtgt

SEQ ID NO: 6274 - DNA, 32 bp, Homo sapiens
tcctgccctcaagtggcttccacctcaagtgg

SEQ ID NO: 6275 - DNA, 32 bp, Homo sapiens
agcctcctgagtagctgggattacaggtatgt

SEQ ID NO: 6276 - DNA, 18 bp, Homo sapiens
gcccctgcccctgcccag

SEQ ID NO: 6277 - DNA, 23 bp, Homo sapiens
cacgcctctaatcccagcacttt

SEQ ID NO: 6278 - DNA, 19 bp, Homo sapiens
gggccaccgtctccaagga

SEQ ID NO: 6279 - DNA, 32 bp, Homo sapiens
cactgtcccccaggctggagtgcagtggcatg

SEQ ID NO: 6280 - DNA, 32 bp, Homo sapiens
cctagtggaggaggctcttcagtctcctgatt

SEQ ID NO: 6281 - DNA, 32 bp, Homo sapiens
gccgtgtttgtgtccctgattacttgagatta

SEQ ID NO: 6282 - DNA, 32 bp, Homo sapiens
agatggcatccctcatcagggttgccagatgg

SEQ ID NO: 6283 - DNA, 21 bp, Homo sapiens
ctgcagggtgtgggcagagaa

SEQ ID NO: 6284 - DNA, 32 bp, Homo sapiens
agtttcctcattttgtttgacagggtcctcag

SEQ ID NO: 6285 - DNA, 32 bp, Homo sapiens
gagcttctctgggctgaatgtatgtcagtgct

SEQ ID NO: 6286 - DNA, 32 bp, Homo sapiens
ttgagacaaagtttcgctcttgttgcccaggc

SEQ ID NO: 6287 - DNA, 32 bp, Homo sapiens
ttgagatgaagttttactcttgttgcccaggc

SEQ ID NO: 6288 - DNA, 32 bp, Homo sapiens
ttaggcccagttcatgctaaaagatggactct

SEQ ID NO: 6289 - DNA, 32 bp, Homo sapiens
aaagttaagcattaatcagatatttcattttt

SEQ ID NO: 6290 - DNA, 23 bp, Homo sapiens
ctgctcacccatctgtgcaggtg

SEQ ID NO: 6291 - DNA, 32 bp, Homo sapiens
gccccagaacaacagtttcactttgtggcttt

SEQ ID NO: 6292 - DNA, 32 bp, Homo sapiens
ggccgtagagggaaacagccactgtgacaacc

SEQ ID NO: 6293 - DNA, 32 bp, Homo sapiens
ttccaggtgccctggctggagtcagtcctcat

SEQ ID NO: 6294 - DNA, 32 bp, Homo sapiens
tctcgttgcccaggctggagtgcaatggcgcg

SEQ ID NO: 6295 - DNA, 32 bp, Homo sapiens
gacgaatggatggatggatggatggatgttgg

SEQ ID NO: 6296 - DNA, 32 bp, Homo sapiens
atttctgtctcccttccatcttttctcccatt

SEQ ID NO: 6297 - DNA, 32 bp, Homo sapiens
acctccgcctcttgggttcaaccgattctcct

SEQ ID NO: 6298 - DNA, 32 bp, Homo sapiens
gaacccaggaggcggaggttgcagtgagcaga

SEQ ID NO: 6299 - DNA, 32 bp, Homo sapiens
ggaggagggaggcaggaggtgaggttggaagt

SEQ ID NO: 6300 - DNA, 32 bp, Homo sapiens
tgggggtggggcgccttcctggaggtgacact

SEQ ID NO: 6301 - DNA, 31 bp, Homo sapiens
agagcaatgaacaggagaaggagggagagag

SEQ ID NO: 6302 - DNA, 22 bp, Homo sapiens
ggtgcagtgtgctgtccagaga

SEQ ID NO: 6303 - DNA, 32 bp, Homo sapiens
tgtggcccaacaagaggaagctctcccctgac

SEQ ID NO: 6304 - DNA, 32 bp, Homo sapiens
cttgttcatcttctgaccgtttgctgggctat

SEQ ID NO: 6305 - DNA, 32 bp, Homo sapiens
gtgcagtgttggagagtgacactgtcggggca

SEQ ID NO: 6306 - DNA, 32 bp, Homo sapiens
agatgactgaggacatcgcctttgccaaggcc

SEQ ID NO: 6307 - DNA, 32 bp, Homo sapiens
gcagttcagcaactcttaagtgacacagttca

SEQ ID NO: 6308 - DNA, 32 bp, Homo sapiens
gtaatttaacatcatgattaccaccttcgaag

SEQ ID NO: 6309 - DNA, 21 bp, Homo sapiens
tgtaagaagaagagatgagga

SEQ ID NO: 6310 - DNA, 32 bp, Homo sapiens
ctcctggactcccctccctgccgaacacacat

SEQ ID NO: 6311 - DNA, 25 bp, Homo sapiens
cgtcgcccaggctggagcgcagtgg

SEQ ID NO: 6312 - DNA, 32 bp, Homo sapiens
tctcattgcccaggctggagtgcagtgagcta

SEQ ID NO: 6313 - DNA, 32 bp, Homo sapiens
gccaagcagccagcagcctagcagccagtcag

SEQ ID NO: 6314 - DNA, 32 bp, Homo sapiens
aaccccagctctgcctcacaggcaggcaggcc

SEQ ID NO: 6315 - DNA, 20 bp, Homo sapiens
gccatcactgcttggaagag

SEQ ID NO: 6316 - DNA, 32 bp, Homo sapiens
cttgcactgccaggctggctgtagcgactctg

SEQ ID NO: 6317 - DNA, 32 bp, Homo sapiens
caccttgttcccaggctgtgccgtcttctcct

SEQ ID NO: 6318 - DNA, 32 bp, Homo sapiens
attaatcagttcattagaaatattttaaaatc

SEQ ID NO: 6319 - DNA, 32 bp, Homo sapiens
tagatcatggcaaggcctgacaacagctgagc

SEQ ID NO: 6320 - DNA, 32 bp, Homo sapiens
ctgctcgggaggctgaggcaggagaatggtgt

SEQ ID NO: 6321 - DNA, 32 bp, Homo sapiens
aactggagctccatctttgctgctaagaaggc

SEQ ID NO: 6322 - DNA, 32 bp, Homo sapiens
acctctgccccctgggttcaagcgattctcct

SEQ ID NO: 6323 - DNA, 32 bp, Homo sapiens
acttcacttgatagtttttaagcaattagaat

SEQ ID NO: 6324 - DNA, 28 bp, Homo sapiens
gctcacccaagtgctagctctgcacttc

SEQ ID NO: 6325 - DNA, 32 bp, Homo sapiens
aggctgtgtcatgggcgtccttaactttggga

SEQ ID NO: 6326 - DNA, 32 bp, Homo sapiens
attctttactgcactcagatttaagccttaca

SEQ ID NO: 6327 - DNA, 32 bp, Homo sapiens
ttttgcttcctgcactttgaagctcctttacg

SEQ ID NO: 6328 - DNA, 32 bp, Homo sapiens
ttatactgttgattactttcagtattaatata

SEQ ID NO: 6329 - DNA, 32 bp, Homo sapiens
tagaccagaagaggatgacaatggcaacaagt

SEQ ID NO: 6330 - DNA, 32 bp, Homo sapiens
tagatagtggatgaagaaagaaggacgaggaa

SEQ ID NO: 6331 - DNA, 32 bp, Homo sapiens
ctcttgtcgcccaggctggagtgcaatggcgt

SEQ ID NO: 6332 - DNA, 24 bp, Homo sapiens
tcatgcctataattccaacccttt

SEQ ID NO: 6333 - DNA, 27 bp, Homo sapiens
gggcaccgatgagggctggtcctagga

SEQ ID NO: 6334 - DNA, 24 bp, Homo sapiens
ggtcttcaggagctggtccaagga

SEQ ID NO: 6335 - DNA, 32 bp, Homo sapiens
tcctgggctcaagcgatccttctgcctcagcc

SEQ ID NO: 6336 - DNA, 32 bp, Homo sapiens
tggcagggttctgtgctcaggtgggaaatctg

SEQ ID NO: 6337 - DNA, 32 bp, Homo sapiens
ccaaactctgtgtcagcatctttgcccttctg

SEQ ID NO: 6338 - DNA, 32 bp, Homo sapiens
ctctgttgaccaggctggagtgcagtggtgag

SEQ ID NO: 6339 - DNA, 27 bp, Homo sapiens
ctctgtcacccaggctggagtgcagtg

SEQ ID NO: 6340 - DNA, 32 bp, Homo sapiens
atgatgagcctatcatttgatttgagttctat

SEQ ID NO: 6341 - DNA, 32 bp, Homo sapiens
ggaagggggaatctgcctcttgttgccatggg

SEQ ID NO: 6342 - DNA, 32 bp, Homo sapiens
tcccaggccctctcaggattgcagaacaacac

SEQ ID NO: 6343 - DNA, 32 bp, Homo sapiens
gcagagaggttgagaacaacccagaaaccttc

SEQ ID NO: 6344 - DNA, 32 bp, Homo sapiens
ctggtggaggagctgggcttctctccaaggac

SEQ ID NO: 6345 - DNA, 32 bp, Homo sapiens
aaaatcacaaaccttgaaaaattttacatcag

SEQ ID NO: 6346 - DNA, 32 bp, Homo sapiens
catggatgaagtttcgctgggtgctcgtgact

SEQ ID NO: 6347 - DNA, 32 bp, Homo sapiens
ctcttgttgcccagactggagtgcaatggcac

SEQ ID NO: 6348 - DNA, 32 bp, Homo sapiens
ctcttgttgcccaggctggagtgcaatggcgc

SEQ ID NO: 6349 - DNA, 32 bp, Homo sapiens
cttttgttgcccaggctggagtgcaacggcgc

SEQ ID NO: 6350 - DNA, 32 bp, Homo sapiens
ctctagggacactggcagctgtggaaatgaat

SEQ ID NO: 6351 - DNA, 32 bp, Homo sapiens
gtttggttccaagcacttcccacctcaaactc

SEQ ID NO: 6352 - DNA, 32 bp, Homo sapiens
ggctcatgcttgtaatcccagcactttgggag

SEQ ID NO: 6353 - DNA, 32 bp, Homo sapiens
ggctcatgcctgtaatctcagcactttgggag

SEQ ID NO: 6354 - DNA, 23 bp, Homo sapiens
catgcctgtaatcccagcatttt

SEQ ID NO: 6355 - DNA, 21 bp, Homo sapiens
tcatgcctgtaatcccagcac

SEQ ID NO: 6356 - DNA, 32 bp, Homo sapiens
ctgagctcaagcagttctcccacctgggcctc

SEQ ID NO: 6357 - DNA, 24 bp, Homo sapiens
ctgtcgcccaggctggagtacaat

SEQ ID NO: 6358 - DNA, 32 bp, Homo sapiens
ctccttgcaaattcctttcttctgcctctgtt

SEQ ID NO: 6359 - DNA, 32 bp, Homo sapiens
ttcggatatcttctcacctatgttccctggct

SEQ ID NO: 6360 - DNA, 32 bp, Homo sapiens
tttgctcttacccaggctgagtgcagtggcag

SEQ ID NO: 6361 - DNA, 32 bp, Homo sapiens
gtgatgttgcccaggctagagtgcagtggcac

SEQ ID NO: 6362 - DNA, 22 bp, Homo sapiens
acaggcgtcagccaccatgccc

SEQ ID NO: 6363 - DNA, 32 bp, Homo sapiens
gaaccccggagatggaggttgcagtgagccaa

SEQ ID NO: 6364 - DNA, 32 bp, Homo sapiens
gaaaccgggaggcggaggttgaggtgagccga

SEQ ID NO: 6365 - DNA, 32 bp, Homo sapiens
caaagcccttcaggctggagtatagtggcatg

SEQ ID NO: 6366 - DNA, 32 bp, Homo sapiens
ggcctcctgagtagctgggacgacaggcgtgc

SEQ ID NO: 6367 - DNA, 32 bp, Homo sapiens
cgagtgaagaattcagcagctaagtggaagtt

SEQ ID NO: 6368 - DNA, 32 bp, Homo sapiens
tccagccccaggacaggaaacagaactgcctg

SEQ ID NO: 6369 - DNA, 31 bp, Homo sapiens
ttttcataataaaaagttaggagggaaacat

SEQ ID NO: 6370 - DNA, 32 bp, Homo sapiens
agtcaggggcttggttctcccacttacactgt

SEQ ID NO: 6371 - DNA, 32 bp, Homo sapiens
gactcacacctgcaatcccagcactttgggag

SEQ ID NO: 6372 - DNA, 32 bp, Homo sapiens
ttgcaacactggctggccatctggcctgcctg

SEQ ID NO: 6373 - DNA, 32 bp, Homo sapiens
cacaagcctcctctccccagtctgccccactt

SEQ ID NO: 6374 - DNA, 31 bp, Homo sapiens
gcagcttgagctacaatcaggagggaaattg

SEQ ID NO: 6375 - DNA, 21 bp, Homo sapiens
ccaggcttgcccctcagctca

SEQ ID NO: 6376 - DNA, 32 bp, Homo sapiens
aaacctgactctgcttctctcatttgtcttcc

SEQ ID NO: 6377 - DNA, 32 bp, Homo sapiens
gtcagcccattggctcccatctgaaccacttt

SEQ ID NO: 6378 - DNA, 20 bp, Homo sapiens
gtcgcccaggctggagtgca

SEQ ID NO: 6379 - DNA, 32 bp, Homo sapiens
agttgtcctcaaggtcatcctggagatgggat

SEQ ID NO: 6380 - DNA, 24 bp, Homo sapiens
ctgttggccaggctggaatgcagt

SEQ ID NO: 6381 - DNA, 32 bp, Homo sapiens
gtctgctggtggtctgcttaccacagaatcct

SEQ ID NO: 6382 - DNA, 32 bp, Homo sapiens
gtcgccgcagaactgccacgtggggatgagat

SEQ ID NO: 6383 - DNA, 23 bp, Homo sapiens
tggcacgatcctggttcactgca

SEQ ID NO: 6384 - DNA, 32 bp, Homo sapiens
gcccaggctgaagtgtagagtgcagtggcatg

SEQ ID NO: 6385 - DNA, 32 bp, Homo sapiens
tgttgtaagtgtttacaactggcatgtgcttt

SEQ ID NO: 6386 - DNA, 32 bp, Homo sapiens
cgctctgtcgcctggctggagtgcagtggtgt

SEQ ID NO: 6387 - DNA, 32 bp, Homo sapiens
atctgtcacccaggctggagtgcagtggcatg

SEQ ID NO: 6388 - DNA, 32 bp, Homo sapiens
ctctgtcagccaggctggagtgcaatggcatg

SEQ ID NO: 6389 - DNA, 32 bp, Homo sapiens
tataagaccttaaggctgggtgcagtggctca

SEQ ID NO: 6390 - DNA, 32 bp, Homo sapiens
gagcacaggagtttgaggctgcagtgacctat

SEQ ID NO: 6391 - DNA, 32 bp, Homo sapiens
ccgcagcgtcggggctggagcgatggcggcga

SEQ ID NO: 6392 - DNA, 32 bp, Homo sapiens
tgtcaaaaatcaggctggagtgcagtggcatg

SEQ ID NO: 6393 - DNA, 32 bp, Homo sapiens
agcctcccgagtagctgggattacaagcaccc

SEQ ID NO: 6394 - DNA, 32 bp, Homo sapiens
ttcatattctattattgaacagtattaatgct

SEQ ID NO: 6395 - DNA, 32 bp, Homo sapiens
agcctcctgagtagctgggattacaggctcct

SEQ ID NO: 6396 - DNA, 32 bp, Homo sapiens
agcctcctgagtagctgggactacaggcccct

SEQ ID NO: 6397 - DNA, 32 bp, Homo sapiens
gactcacatcttcactcctgggcctttgcact

SEQ ID NO: 6398 - DNA, 32 bp, Homo sapiens
ccaggttcaagcaattctcctgcctcagcctc

SEQ ID NO: 6399 - DNA, 32 bp, Homo sapiens
ccaggttcaagcagttctcctacctcagcctc

SEQ ID NO: 6400 - DNA, 32 bp, Homo sapiens
tgcaatggctcaggttctcttccagcctgtcc

SEQ ID NO: 6401 - DNA, 23 bp, Homo sapiens
tctgacgcaccactgccaatgct

SEQ ID NO: 6402 - DNA, 32 bp, Homo sapiens
cttcggatgaatccctggaaagcagagaggca

SEQ ID NO: 6403 - DNA, 32 bp, Homo sapiens
ctgccagtgctgctggtgcacagaccatcttt

SEQ ID NO: 6404 - DNA, 32 bp, Homo sapiens
cctgcagtgctgctgccctcgtctaccagtgg

SEQ ID NO: 6405 - DNA, 32 bp, Homo sapiens
tgggctcctcaagggacttcctggagagtagc

SEQ ID NO: 6406 - DNA, 32 bp, Homo sapiens
aggttgttgcggatgcttctctctccaggcgc

SEQ ID NO: 6407 - DNA, 32 bp, Homo sapiens
atgttaattattttgacaaatatttcatatat

SEQ ID NO: 6408 - DNA, 32 bp, Homo sapiens
tattgtattggccatcccttgtttcatattcg

SEQ ID NO: 6409 - DNA, 32 bp, Homo sapiens
ttgggatctgccaggctggggtgttttcggta

SEQ ID NO: 6410 - DNA, 32 bp, Homo sapiens
actctgtcgcccaggctggactgcagtggtgc

SEQ ID NO: 6411 - DNA, 32 bp, Homo sapiens
gctgtgttcaggatgttgaagtgcagtgtcag

SEQ ID NO: 6412 - DNA, 32 bp, Homo sapiens
ggtccgtgcccaggcccttggctgcaggcaac

SEQ ID NO: 6413 - DNA, 32 bp, Homo sapiens
ttttaagaacaacagcccttcaggcggcgaaa

SEQ ID NO: 6414 - DNA, 32 bp, Homo sapiens
tctctgtcgcccaggctggagtacagtggtgc

SEQ ID NO: 6415 - DNA, 32 bp, Homo sapiens
gaacccaggaggcggaagttgcagtgagctga

SEQ ID NO: 6416 - DNA, 32 bp, Homo sapiens
gaacctgggaggcggaagttgcagtgagccaa

SEQ ID NO: 6417 - DNA, 32 bp, Homo sapiens
ttacgaaatgctagccagggtgcaatggctca

SEQ ID NO: 6418 - DNA, 32 bp, Homo sapiens
gaacctggaaggcggaggttgcagtgagccaa

SEQ ID NO: 6419 - DNA, 32 bp, Homo sapiens
aaacccaggaggcggaggttgcagtgagctga

SEQ ID NO: 6420 - DNA, 32 bp, Homo sapiens
gaacccaggaggcagtgattgcagtgagctga

SEQ ID NO: 6421 - DNA, 32 bp, Homo sapiens
acctccacctcctgggttcaagcagttctccc

SEQ ID NO: 6422 - DNA, 28 bp, Homo sapiens
ctccatccctttgatgcctcatccatct

SEQ ID NO: 6423 - DNA, 32 bp, Homo sapiens
ccagcggcctgccgggagttgcagtgaaccca

SEQ ID NO: 6424 - DNA, 32 bp, Homo sapiens
ggcctctccagtagctgggattacaggtgtgc

SEQ ID NO: 6425 - DNA, 32 bp, Homo sapiens
caagcgcagagagggagagaattctccacaaa

SEQ ID NO: 6426 - DNA, 32 bp, Homo sapiens
gggcagcacactgggagccatttactttatgc

SEQ ID NO: 6427 - DNA, 32 bp, Homo sapiens
gaaggcaagctccaaacccctgcctggaagac

SEQ ID NO: 6428 - DNA, 32 bp, Homo sapiens
ggccctgggttagagtctgggcgtggacgcgc

SEQ ID NO: 6429 - DNA, 32 bp, Homo sapiens
tgctctgtcgccaagccagagtgcagtggtgt

SEQ ID NO: 6430 - DNA, 32 bp, Homo sapiens
ctgggctcaagccttcctcccacctgaacctc

SEQ ID NO: 6431 - DNA, 32 bp, Homo sapiens
ggcccagatcttctcacctaggactttttaaa

SEQ ID NO: 6432 - DNA, 32 bp, Homo sapiens
tggccaaatttcctacagcgagattatgaaac

SEQ ID NO: 6433 - DNA, 32 bp, Homo sapiens
atcaacaatagaagaagaagaaaacatgtcag

SEQ ID NO: 6434 - DNA, 32 bp, Homo sapiens
catgatacatcttttctcagtgaacataaaac

SEQ ID NO: 6435 - DNA, 32 bp, Homo sapiens
aactcccagctttcggacatctggcacacggg

SEQ ID NO: 6436 - DNA, 32 bp, Homo sapiens
ggacaggtgatctggggaaaacgcagctacac

SEQ ID NO: 6437 - DNA, 32 bp, Homo sapiens
tcactgttgcccaggctggcgtgcagtggtgc

SEQ ID NO: 6438 - DNA, 32 bp, Homo sapiens
actgaacacatccagccacaggcaccagctgg

SEQ ID NO: 6439 - DNA, 32 bp, Homo sapiens
cagctctagacactgccacacagggtctgcaa

SEQ ID NO: 6440 - DNA, 32 bp, Homo sapiens
agctacgatgttcttccagggcactgggggct

SEQ ID NO: 6441 - DNA, 32 bp, Homo sapiens
cccacctggtagacacggtcactgtgacagga

SEQ ID NO: 6442 - DNA, 32 bp, Homo sapiens
tctctctcacccaggctggagtggagtggcgc

SEQ ID NO: 6443 - DNA, 32 bp, Homo sapiens
gaacctgggaggcagaggttgcagtgatccga

SEQ ID NO: 6444 - DNA, 32 bp, Homo sapiens
tttctacaactccgactcatttgctacattcc

SEQ ID NO: 6445 - DNA, 32 bp, Homo sapiens
gacaagtatctagccagtctttgctacaagtt

SEQ ID NO: 6446 - DNA, 32 bp, Homo sapiens
aggggtgggcagtcagggttgcaggactgtaa

SEQ ID NO: 6447 - DNA, 32 bp, Homo sapiens
aactgggggaggcagggcacagggagatgctc

SEQ ID NO: 6448 - DNA, 32 bp, Homo sapiens
aaagtattggggtggaggttgcagtgagcaga

SEQ ID NO: 6449 - DNA, 32 bp, Homo sapiens
aacaccgcctcccgggttcaagcgattctcct

SEQ ID NO: 6450 - DNA, 28 bp, Homo sapiens
gtctctcgggtgatggcctcatccaggg

SEQ ID NO: 6451 - DNA, 32 bp, Homo sapiens
ctgcccccaagtgtaactccagcactgtgagg

SEQ ID NO: 6452 - DNA, 32 bp, Homo sapiens
agcggggtctgtgggagctagctttgtcagtg

SEQ ID NO: 6453 - DNA, 23 bp, Homo sapiens
ctgtggccgtcagtggaatgcag

SEQ ID NO: 6454 - DNA, 32 bp, Homo sapiens
tctctctgtaccacgtgcacatgaggtccatt

SEQ ID NO: 6455 - DNA, 32 bp, Homo sapiens
tcagtcaaggacaaacctcccacctcacagac

SEQ ID NO: 6456 - DNA, 32 bp, Homo sapiens
gtctcatgcctgtaatcccagcactttgggag

SEQ ID NO: 6457 - DNA, 32 bp, Homo sapiens
ctgcagcagtcacctacccccacctgtcccac

SEQ ID NO: 6458 - DNA, 32 bp, Homo sapiens
tggcccatagaaacatgacactgaccttggag

SEQ ID NO: 6459 - DNA, 32 bp, Homo sapiens
gagggaaggtgatgacttaaatggcagggggt

SEQ ID NO: 6460 - DNA, 32 bp, Homo sapiens
cttagagttgtctaagttgggtgcaaattttc

SEQ ID NO: 6461 - DNA, 32 bp, Homo sapiens
ttcagtttccccaagtacctgttttcattccc

SEQ ID NO: 6462 - DNA, 32 bp, Homo sapiens
gacccaggtgaacacgctgactgtgaacctgc

SEQ ID NO: 6463 - DNA, 32 bp, Homo sapiens
tgtgagattaaccttgggacacagtgggttag

SEQ ID NO: 6464 - DNA, 32 bp, Homo sapiens
acaacagagacggatggtgtttctgagaggaa

SEQ ID NO: 6465 - DNA, 32 bp, Homo sapiens
gctctgttgcccaggctggagtacatttgcct

SEQ ID NO: 6466 - DNA, 32 bp, Homo sapiens
gagatcgttcccaggctggcgtctctggggtt

SEQ ID NO: 6467 - DNA, 32 bp, Homo sapiens
gtgccccacatcctcttattcctacatccctt

SEQ ID NO: 6468 - DNA, 32 bp, Homo sapiens
gatgttgcaccagaagagagtgcagtgttgga

SEQ ID NO: 6469 - DNA, 32 bp, Homo sapiens
cctgtgggtagaggaaagagtgatctggtgtc

SEQ ID NO: 6470 - DNA, 32 bp, Homo sapiens
gaacccgggaggtagaggctgcagtgagccga

SEQ ID NO: 6471 - DNA, 32 bp, Homo sapiens
tccacagggaggcaggtggccacggcgaggtc

SEQ ID NO: 6472 - DNA, 32 bp, Homo sapiens
cggagcaggaggcagaggagcagatggagcag

SEQ ID NO: 6473 - DNA, 32 bp, Homo sapiens
atcttgaactcctgggctcaagcaatctgcca

SEQ ID NO: 6474 - DNA, 32 bp, Homo sapiens
tgggtccccagtgccctcagccccgcagcgta

SEQ ID NO: 6475 - DNA, 32 bp, Homo sapiens
catttcccaagtgcttcatgttagccagcaaa

SEQ ID NO: 6476 - DNA, 32 bp, Homo sapiens
agcctcccaagtagctgggattacaccaccat

SEQ ID NO: 6477 - DNA, 32 bp, Homo sapiens
agcctccctggcagctgggattacaggtgcac

SEQ ID NO: 6478 - DNA, 32 bp, Homo sapiens
ccagcctcaggtgatccacccacctcagcctc

SEQ ID NO: 6479 - DNA, 32 bp, Homo sapiens
ggctcacacctgtattcccagcactttgggag

SEQ ID NO: 6480 - DNA, 32 bp, Homo sapiens
ttcccgtaattacttattgcagtattgtgttc

SEQ ID NO: 6481 - DNA, 32 bp, Homo sapiens
ttccagctcagagctcctcccaccccaacata

SEQ ID NO: 6482 - DNA, 32 bp, Homo sapiens
atgcttttaaccaattctcaaatcttactaaa

SEQ ID NO: 6483 - DNA, 32 bp, Homo sapiens
ctgaactcaagcaattctcctgccttggcctc

SEQ ID NO: 6484 - DNA, 32 bp, Homo sapiens
tcttgggctcaagccatccttctgcctcactg

SEQ ID NO: 6485 - DNA, 32 bp, Homo sapiens
ctgcaacatcttctcctccaggaaggcttcct

SEQ ID NO: 6486 - DNA, 19 bp, Homo sapiens
gggcggcccggcaagcagc

SEQ ID NO: 6487 - DNA, 23 bp, Homo sapiens
attgaaataaaatggatctgcca

SEQ ID NO: 6488 - DNA, 24 bp, Homo sapiens
gtcactcaggctggagtgcaatga

SEQ ID NO: 6489 - DNA, 32 bp, Homo sapiens
gccctctccttccccgaacacagcacacggtc

SEQ ID NO: 6490 - DNA, 32 bp, Homo sapiens
gctctgttggccaggctggaatgcagtggcac

SEQ ID NO: 6491 - DNA, 32 bp, Homo sapiens
gccttcttccccaggctgggagtgggtgagac

SEQ ID NO: 6492 - DNA, 32 bp, Homo sapiens
actctgccacccaagctggagtgcagtggcac

SEQ ID NO: 6493 - DNA, 32 bp, Homo sapiens
ttcccttccacaggctggttgcatgtgccatg

SEQ ID NO: 6494 - DNA, 32 bp, Homo sapiens
atccccaaacagtaggcttcagttccctgcca

SEQ ID NO: 6495 - DNA, 32 bp, Homo sapiens
gctctgttgcccaggctggagtgtagagacac

SEQ ID NO: 6496 - DNA, 32 bp, Homo sapiens
gtcagctaacttcagcctgtgctgctgggccc

SEQ ID NO: 6497 - DNA, 32 bp, Homo sapiens
ctctgtcacacaggctggagtgcagtggcacg

SEQ ID NO: 6498 - DNA, 32 bp, Homo sapiens
ctctgccacccaagctggagtgcagtggcacg

SEQ ID NO: 6499 - DNA, 28 bp, Homo sapiens
ctcactggccctgctgcctcttcaagtt

SEQ ID NO: 6500 - DNA, 32 bp, Homo sapiens
gaacccgggaggcggaggttacagtgagccga

SEQ ID NO: 6501 - DNA, 32 bp, Homo sapiens
gagtccaggaggttgaggctgcagtgagctgt

SEQ ID NO: 6502 - DNA, 32 bp, Homo sapiens
acgtccgcctcctgggttcaagtgattcttct

SEQ ID NO: 6503 - DNA, 32 bp, Homo sapiens
tatttctcacccaggagtggatttgtggtttg

SEQ ID NO: 6504 - DNA, 32 bp, Homo sapiens
tttcatattcaccattcttccacctcattgaa

SEQ ID NO: 6505 - DNA, 32 bp, Homo sapiens
agcctcccgagtagctgggattacaggaatct

SEQ ID NO: 6506 - DNA, 19 bp, Homo sapiens
tcatgcctgtaatcccagc

SEQ ID NO: 6507 - DNA, 23 bp, Homo sapiens
tcacgcctgtaatcccaacactt

SEQ ID NO: 6508 - DNA, 32 bp, Homo sapiens
agagagaaagaatgagaaagaaaaggaatgca

SEQ ID NO: 6509 - DNA, 32 bp, Homo sapiens
atggcggccctgtcttcttggccctggcactg

SEQ ID NO: 6510 - DNA, 32 bp, Homo sapiens
ccaaagtgccagccttctcttctgccttacct

SEQ ID NO: 6511 - DNA, 15 bp, Homo sapiens
cccctgcccccggtg

SEQ ID NO: 6512 - DNA, 20 bp, Homo sapiens
cagacccaccagacaccaca

SEQ ID NO: 6513 - DNA, 24 bp, Homo sapiens
tggcatgatcttggctcacttcag

SEQ ID NO: 6514 - DNA, 32 bp, Homo sapiens
accaagtgaaacgtctcacaggcccaggactt

SEQ ID NO: 6515 - DNA, 32 bp, Homo sapiens
tctctgtcgcccaggctggggtgcagtggcgc

SEQ ID NO: 6516 - DNA, 32 bp, Homo sapiens
cgctctgttgccaggctggagggcagtggcac

SEQ ID NO: 6517 - DNA, 32 bp, Homo sapiens
tttctgtcgtccaggctggagtgcagtagcgc

SEQ ID NO: 6518 - DNA, 32 bp, Homo sapiens
actccaggctcaggctggagccgtgatggcac

SEQ ID NO: 6519 - DNA, 32 bp, Homo sapiens
agatgcccatctggagtgagtgcaggaccagg

SEQ ID NO: 6520 - DNA, 32 bp, Homo sapiens
gacagcaaagagactgagagactgttgatcaa

SEQ ID NO: 6521 - DNA, 32 bp, Homo sapiens
gaacccgggaggcagaggttgcagtgtggtga

SEQ ID NO: 6522 - DNA, 32 bp, Homo sapiens
tggcaccgagagggctggagtgcagtggcgtg

SEQ ID NO: 6523 - DNA, 32 bp, Homo sapiens
gctctttgcccagctcctggggtgggagtggt

SEQ ID NO: 6524 - DNA, 32 bp, Homo sapiens
aaacatgggaggcggaggttgcagtgagccga

SEQ ID NO: 6525 - DNA, 32 bp, Homo sapiens
gaacccagcaggcagaggttgcagtgagccaa

SEQ ID NO: 6526 - DNA, 32 bp, Homo sapiens
gaacccggcaggcagaggttgcagtgagccga

SEQ ID NO: 6527 - DNA, 28 bp, Homo sapiens
aagacccagagacctgcctcaccagtgc

SEQ ID NO: 6528 - DNA, 32 bp, Homo sapiens
caccttcctggtgcccttcagccaggtccaga

SEQ ID NO: 6529 - DNA, 32 bp, Homo sapiens
tccacttcatgagtgttttacaacagcacttg

SEQ ID NO: 6530 - DNA, 32 bp, Homo sapiens
tcattgcaggaatgaatgctgtggaagaaaac

SEQ ID NO: 6531 - DNA, 32 bp, Homo sapiens
agatgcttttgtacgggttcccatgaatcttc

SEQ ID NO: 6532 - DNA, 32 bp, Homo sapiens
agcctctcaagtagctgggattacaagcatgc

SEQ ID NO: 6533 - DNA, 32 bp, Homo sapiens
agcctcctgattagctgggattacaggcgtgt

SEQ ID NO: 6534 - DNA, 32 bp, Homo sapiens
agcctctcaagtagctgggattacagggcttc

SEQ ID NO: 6535 - DNA, 32 bp, Homo sapiens
ttgtcacatcttcccaagccaggccagccagg

SEQ ID NO: 6536 - DNA, 32 bp, Homo sapiens
ccttacgtgcttctcccctggacctatgtgca

SEQ ID NO: 6537 - DNA, 32 bp, Homo sapiens
gggaagaggaaaatgaggcaagatgctgagaa

SEQ ID NO: 6538 - DNA, 32 bp, Homo sapiens
gggtttgtctgtccctgacttctgcctctgag

SEQ ID NO: 6539 - DNA, 32 bp, Homo sapiens
acatgtactgcagcttcttgtctctgttttgg

SEQ ID NO: 6540 - DNA, 32 bp, Homo sapiens
gagtgagctctgctgcctcttctgctgcccgc

SEQ ID NO: 6541 - DNA, 32 bp, Homo sapiens
aagaatcctaacctcaaagggtcgtggtgaga

SEQ ID NO: 6542 - DNA, 32 bp, Homo sapiens
tcgtgccagcaaggagcctactgtctggtgtg

SEQ ID NO: 6543 - DNA, 23 bp, Homo sapiens
ggtctgggagctgttctggggca

SEQ ID NO: 6544 - DNA, 32 bp, Homo sapiens
ctttcagtgctgctgtttggcccagctcatta

SEQ ID NO: 6545 - DNA, 32 bp, Homo sapiens
cctgtgtgccggctgctcactgctgtgaccag

SEQ ID NO: 6546 - DNA, 22 bp, Homo sapiens
gtcacccaggctggagtgtagt

SEQ ID NO: 6547 - DNA, 32 bp, Homo sapiens
ttgcacactcactggcatctttgctatgggga

SEQ ID NO: 6548 - DNA, 32 bp, Homo sapiens
ctgcatgtctccattcttctctgtctctgtct

SEQ ID NO: 6549 - DNA, 23 bp, Homo sapiens
tggctggatctcagctcactgca

SEQ ID NO: 6550 - DNA, 32 bp, Homo sapiens
tccctggcgaggcagacgctgcgggtggagac

SEQ ID NO: 6551 - DNA, 32 bp, Homo sapiens
tccgggaggcccagggaaggtgcaatggatga

SEQ ID NO: 6552 - DNA, 32 bp, Homo sapiens
tggagctacatcctgcttcctttgggcctggg

SEQ ID NO: 6553 - DNA, 32 bp, Homo sapiens
acctccaccttcctggttcaagcgattctgcc

SEQ ID NO: 6554 - DNA, 28 bp, Homo sapiens
taatttacaagtgctggtacatcttttt

SEQ ID NO: 6555 - DNA, 28 bp, Homo sapiens
ccccacctctgtgctgccccatccacct

SEQ ID NO: 6556 - DNA, 32 bp, Homo sapiens
aaactctgcccaacaggagagatctagttttc

SEQ ID NO: 6557 - DNA, 32 bp, Homo sapiens
tattctcaacatctgtttttggtgttaagcta

SEQ ID NO: 6558 - DNA, 32 bp, Homo sapiens
tctcctgtgccaagctgctccctgaaatggac

SEQ ID NO: 6559 - DNA, 32 bp, Homo sapiens
cttcgttcagcctccctccccacctcacccca

SEQ ID NO: 6560 - DNA, 32 bp, Homo sapiens
ttctgacctcttagctggggattccatggcca

SEQ ID NO: 6561 - DNA, 32 bp, Homo sapiens
agcctcccgagtagctgggattacagggtgaa

SEQ ID NO: 6562 - DNA, 24 bp, Homo sapiens
tcatgcctgtaatcctagcacttt

SEQ ID NO: 6563 - DNA, 21 bp, Homo sapiens
cagcctggccaactgcctgaa

SEQ ID NO: 6564 - DNA, 32 bp, Homo sapiens
aaaactaatttccaaaatataagctgttttca

SEQ ID NO: 6565 - DNA, 31 bp, Homo sapiens
agcaagacgaaaacacacaggagggaaaatc

SEQ ID NO: 6566 - DNA, 31 bp, Homo sapiens
gagaggcagcgacatcggaggagggagaggc

SEQ ID NO: 6567 - DNA, 24 bp, Homo sapiens
tcatgcccgtaatcccagcacttt

SEQ ID NO: 6568 - DNA, 32 bp, Homo sapiens
agctcccatccctcgggatgcccaggagaggc

SEQ ID NO: 6569 - DNA, 32 bp, Homo sapiens
cgctgtcgcccaggctggagcgcaatggcgcg

SEQ ID NO: 6570 - DNA, 32 bp, Homo sapiens
tctcaccctcaaggggctcacatggaggacaa

SEQ ID NO: 6571 - DNA, 32 bp, Homo sapiens
aaacaggcaaaccagaatcactgtgaatcaag

SEQ ID NO: 6572 - DNA, 21 bp, Homo sapiens
gaagaaggaagtgaaccctca

SEQ ID NO: 6573 - DNA, 32 bp, Homo sapiens
gggttgcatccctcggaagagcgaaggaatga

SEQ ID NO: 6574 - DNA, 32 bp, Homo sapiens
cgcttgttgcccaggctggaatgcaatggcgt

SEQ ID NO: 6575 - DNA, 32 bp, Homo sapiens
ctcttgttgcccaagctggagtgcaatggcgc

SEQ ID NO: 6576 - DNA, 32 bp, Homo sapiens
gctctgtcacccaggctggagtctagtgtcgt

SEQ ID NO: 6577 - DNA, 32 bp, Homo sapiens
gtccagctacctgactcttttgcaataacaac

SEQ ID NO: 6578 - DNA, 32 bp, Homo sapiens
taatattacaggaaattcttaggatataccat

SEQ ID NO: 6579 - DNA, 32 bp, Homo sapiens
ccctgagtgacggaaagaggtctggcggcttc

SEQ ID NO: 6580 - DNA, 28 bp, Homo sapiens
ctcaggagcaatgctgccttctccctgt

SEQ ID NO: 6581 - DNA, 28 bp, Homo sapiens
tgggcaccacaggctgcctcatgaccct

SEQ ID NO: 6582 - DNA, 32 bp, Homo sapiens
tcttgttgcccaagctggagtgcaatggcgcg

SEQ ID NO: 6583 - DNA, 32 bp, Homo sapiens
agcctctggagtagctgggattacaggtgcgc

SEQ ID NO: 6584 - DNA, 32 bp, Homo sapiens
ttcacgaagaattcaggggatgtgggaagtgg

SEQ ID NO: 6585 - DNA, 32 bp, Homo sapiens
acgtcttcggcggatgtcatggtgctgaacca

SEQ ID NO: 6586 - DNA, 32 bp, Homo sapiens
caaacgcattcactcggggcagtattaaccgt

SEQ ID NO: 6587 - DNA, 32 bp, Homo sapiens
atcggccggcctcgaacccccacagctggagg

SEQ ID NO: 6588 - DNA, 24 bp, Homo sapiens
aagactgtgaaaaatgataactca

SEQ ID NO: 6589 - DNA, 32 bp, Homo sapiens
agctgtcaccttctccctgtctcagctgaggg

SEQ ID NO: 6590 - DNA, 32 bp, Homo sapiens
gtgcagtactcagtaaggcagtgcagtactca

SEQ ID NO: 6591 - DNA, 32 bp, Homo sapiens
catgcagccctctcctcgagcacgtcacacac

SEQ ID NO: 6592 - DNA, 26 bp, Homo sapiens
ctgtgtcgcccaagctagagtgcagt

SEQ ID NO: 6593 - DNA, 32 bp, Homo sapiens
tctcgggctcaagccatttttctgcctcagct

SEQ ID NO: 6594 - DNA, 32 bp, Homo sapiens
gcctcctggagttttattttgtttttctgctt

SEQ ID NO: 6595 - DNA, 23 bp, Homo sapiens
tggcatgatctgggctcactgca

SEQ ID NO: 6596 - DNA, 32 bp, Homo sapiens
tgaatcttgctgctgctcactctttgggtcca

SEQ ID NO: 6597 - DNA, 32 bp, Homo sapiens
gctctcttacccaagctggagtgcagtgacat

SEQ ID NO: 6598 - DNA, 23 bp, Homo sapiens
ggaagcctgcgtgtgcgcagctc

SEQ ID NO: 6599 - DNA, 19 bp, Homo sapiens
gacgtgaatcccactgtgg

SEQ ID NO: 6600 - DNA, 32 bp, Homo sapiens
gaagatgggaagcacagattgcagtgaaccga

SEQ ID NO: 6601 - DNA, 32 bp, Homo sapiens
atagcatttgccctgtggggtgcagtgttacc

SEQ ID NO: 6602 - DNA, 32 bp, Homo sapiens
ttctttttgcccaggctggagtgcagtggcgc

SEQ ID NO: 6603 - DNA, 32 bp, Homo sapiens
tggactagcttgggttggtgatcatgtctcct

SEQ ID NO: 6604 - DNA, 32 bp, Homo sapiens
tctccttaggagtggaggagatgtgtgttctg

SEQ ID NO: 6605 - DNA, 32 bp, Homo sapiens
aaacctgagaggtggaggttgcagttgagcca

SEQ ID NO: 6606 - DNA, 28 bp, Homo sapiens
gaaaggctgaaggctgcctcctcttgca

SEQ ID NO: 6607 - DNA, 28 bp, Homo sapiens
caacattcaaattctgcctcatctggag

SEQ ID NO: 6608 - DNA, 28 bp, Homo sapiens
tcttgcctcagagcagcctcatcccagg

SEQ ID NO: 6609 - DNA, 32 bp, Homo sapiens
agcctcccaagtagctgggattacaggcgcgt

SEQ ID NO: 6610 - DNA, 32 bp, Homo sapiens
gtctaaaacgtacagtctgaggctggggcggg

SEQ ID NO: 6611 - DNA, 32 bp, Homo sapiens
aacaggtacggaatggccctggaacatttcta

SEQ ID NO: 6612 - DNA, 32 bp, Homo sapiens
gtcctctctgcagttttattccctttagtctt

SEQ ID NO: 6613 - DNA, 32 bp, Homo sapiens
aacctgatttagaagaacagaaaacaaaacta

SEQ ID NO: 6614 - DNA, 32 bp, Homo sapiens
ctgggttcaagcaatcctcccacctgtgcctc

SEQ ID NO: 6615 - DNA, 32 bp, Homo sapiens
agtccttgattgttcgggtgtgcaatgtctga

SEQ ID NO: 6616 - DNA, 23 bp, Homo sapiens
ctgtcaccaggctggaatgcagt

SEQ ID NO: 6617 - DNA, 32 bp, Homo sapiens
gtgactcagttgaaactcagtgttgcatacat

SEQ ID NO: 6618 - DNA, 32 bp, Homo sapiens
gaactttcagtactgtactaccacagattgat

SEQ ID NO: 6619 - DNA, 32 bp, Homo sapiens
tacggtcccatctcttcacaggcatggattct

SEQ ID NO: 6620 - DNA, 32 bp, Homo sapiens
ttgattcattgcaggtctcaggcacaggttga

SEQ ID NO: 6621 - DNA, 32 bp, Homo sapiens
ccacggcacatcctgctttgttcaccactggg

SEQ ID NO: 6622 - DNA, 32 bp, Homo sapiens
gctctgttgcccaggctggagtacattggtgt

SEQ ID NO: 6623 - DNA, 32 bp, Homo sapiens
agccagtgttgctggctggagaggcagcaaca

SEQ ID NO: 6624 - DNA, 32 bp, Homo sapiens
acctccacatcctgggttcaagtgattctcct

SEQ ID NO: 6625 - DNA, 32 bp, Homo sapiens
ctctgttgcccaggctggagtgcagtggcgaa

SEQ ID NO: 6626 - DNA, 32 bp, Homo sapiens
tcttgttgcccaggctggagtgcaatggagcg

SEQ ID NO: 6627 - DNA, 32 bp, Homo sapiens
agcttatacctgtaatcctagcactttgggag

SEQ ID NO: 6628 - DNA, 32 bp, Homo sapiens
agcctccctagtagctgggattacagccatgc

SEQ ID NO: 6629 - DNA, 32 bp, Homo sapiens
acctccacctcccgggttcaagggattctgcc

SEQ ID NO: 6630 - DNA, 32 bp, Homo sapiens
tttatagttttaagaggaagaaaacagaaacg

SEQ ID NO: 6631 - DNA, 32 bp, Homo sapiens
aaattgtagaaaactgaaagaaaacaagacaa

SEQ ID NO: 6632 - DNA, 32 bp, Homo sapiens
gaagaaatgaaaggaagaggagcttgagagtc

SEQ ID NO: 6633 - DNA, 32 bp, Homo sapiens
ctctgtcacccaaggcggagtgcagtgacgac

SEQ ID NO: 6634 - DNA, 23 bp, Homo sapiens
acctgctggccatgcaagctgac

SEQ ID NO: 6635 - DNA, 21 bp, Homo sapiens
tgtgagaagcagcagagggga

SEQ ID NO: 6636 - DNA, 32 bp, Homo sapiens
gactccagagcctccagcaagatgctactgat

SEQ ID NO: 6637 - DNA, 32 bp, Homo sapiens
actctgttgccaggctggagtgcagtggcgcg

SEQ ID NO: 6638 - DNA, 32 bp, Homo sapiens
acctttgctgagttccggggtgcaatggggga

SEQ ID NO: 6639 - DNA, 32 bp, Homo sapiens
ggagcatggagtttggactttgctgagcaact

SEQ ID NO: 6640 - DNA, 32 bp, Homo sapiens
ttgagatggagtttcactcttgtcaccgaggc

SEQ ID NO: 6641 - DNA, 32 bp, Homo sapiens
gcgtgtcatcccttgtgccgcaggctgggcgg

SEQ ID NO: 6642 - DNA, 32 bp, Homo sapiens
aaaaccaagcccaggccgggggcggtggctca

SEQ ID NO: 6643 - DNA, 32 bp, Homo sapiens
gctctgttatccaggctggtgtgcagtgatac

SEQ ID NO: 6644 - DNA, 32 bp, Homo sapiens
cttaccccagttcccaaacacaggaagtgatt

SEQ ID NO: 6645 - DNA, 32 bp, Homo sapiens
aaacccaggaggcaaaggctgcagtgagccaa

SEQ ID NO: 6646 - DNA, 32 bp, Homo sapiens
tcttgttgcccaggctggagtgcaatagcgca

SEQ ID NO: 6647 - DNA, 32 bp, Homo sapiens
caatggaagaacaagacatcaaacttcgtgaa

SEQ ID NO: 6648 - DNA, 32 bp, Homo sapiens
gaaaccggaaggcagaggttgcagtgagccaa

SEQ ID NO: 6649 - DNA, 32 bp, Homo sapiens
gaaattgggaggcagggggaataaaggaaatc

SEQ ID NO: 6650 - DNA, 32 bp, Homo sapiens
gaacccaggaggcagaagttgcagtgagccga

SEQ ID NO: 6651 - DNA, 32 bp, Homo sapiens
aaactcgggaggtagaggttgcagtgagccaa

SEQ ID NO: 6652 - DNA, 32 bp, Homo sapiens
gaacctgggaggcagaagttgtggtgagccga

SEQ ID NO: 6653 - DNA, 32 bp, Homo sapiens
taaccttggaggcggaggttgcattgagctga

SEQ ID NO: 6654 - DNA, 28 bp, Homo sapiens
ttctctcccgcagctgcctcagtcggct

SEQ ID NO: 6655 - DNA, 32 bp, Homo sapiens
gagcatctcagagtgagagaaaaatgtagaaa

SEQ ID NO: 6656 - DNA, 32 bp, Homo sapiens
cccagcaggaggcaggggtagagtgatggaag

SEQ ID NO: 6657 - DNA, 32 bp, Homo sapiens
atctccatctcccgggttcaagcgattttcct

SEQ ID NO: 6658 - DNA, 32 bp, Homo sapiens
agctccccttcccaggttcaagcaattctcct

SEQ ID NO: 6659 - DNA, 28 bp, Homo sapiens
tgtgccctgagagctgcctctcaatccc

SEQ ID NO: 6660 - DNA, 32 bp, Homo sapiens
acctccgtctcctgggttcaagcgattctcct

SEQ ID NO: 6661 - DNA, 32 bp, Homo sapiens
agcctcccaagtagctgggactactggcaccc

SEQ ID NO: 6662 - DNA, 32 bp, Homo sapiens
tcaagtaagaattgggttaagggaaaaataga

SEQ ID NO: 6663 - DNA, 32 bp, Homo sapiens
gaaccccaaaccactaaaaactacctaaacac

SEQ ID NO: 6664 - DNA, 32 bp, Homo sapiens
aaagaaagaaagaaagaaagaaaacagttcca

SEQ ID NO: 6665 - DNA, 32 bp, Homo sapiens
ggctcatgcctgtaattccagcactttgggag

SEQ ID NO: 6666 - DNA, 32 bp, Homo sapiens
agctgctcactattatctgcagtattgataag

SEQ ID NO: 6667 - DNA, 22 bp, Homo sapiens
tcagaagggtgccaggccacag

SEQ ID NO: 6668 - DNA, 18 bp, Homo sapiens
catgggtgctgcacccca

SEQ ID NO: 6669 - DNA, 32 bp, Homo sapiens
tattttagaagagaaggagcaagagaagaaga

SEQ ID NO: 6670 - DNA, 25 bp, Homo sapiens
cgtcacccaggctggagtgcagtag

SEQ ID NO: 6671 - DNA, 32 bp, Homo sapiens
ctctgttacccaggctggagtgcagtgggtga

SEQ ID NO: 6672 - DNA, 32 bp, Homo sapiens
ttcgcttgaacagcttctcctgagtcctcctt

SEQ ID NO: 6673 - DNA, 32 bp, Homo sapiens
ttgagacggagtttcgctgttgttgcccaggc

SEQ ID NO: 6674 - DNA, 23 bp, Homo sapiens
tggcacgatctcggctgactgca

SEQ ID NO: 6675 - DNA, 32 bp, Homo sapiens
tcctcctctgatgcgtcacagtcacaggtcct

SEQ ID NO: 6676 - DNA, 32 bp, Homo sapiens
cgcgggcccagaggctggaggcagcggggagc

SEQ ID NO: 6677 - DNA, 32 bp, Homo sapiens
cctcttgattcttggcttgcctctcctccaat

SEQ ID NO: 6678 - DNA, 32 bp, Homo sapiens
ttcagacggagtttcgctcttgttgcccaggc

SEQ ID NO: 6679 - DNA, 32 bp, Homo sapiens
gaacccagggggcagaggttgcagtgagccga

SEQ ID NO: 6680 - DNA, 32 bp, Homo sapiens
agtgaagggaggcagtggcggcggcggcgaac

SEQ ID NO: 6681 - DNA, 32 bp, Homo sapiens
ctctgtcggccaggttggagtgcagtggtgca

SEQ ID NO: 6682 - DNA, 32 bp, Homo sapiens
ctctctgggaggcagatgggagccatggctta

SEQ ID NO: 6683 - DNA, 32 bp, Homo sapiens
gaacctgggaggcagaggttgcagtaagctaa

SEQ ID NO: 6684 - DNA, 32 bp, Homo sapiens
gaacccaggaggcagagattgcggtgagccaa

SEQ ID NO: 6685 - DNA, 28 bp, Homo sapiens
ccctctgccgatgctgcctcctccatgc

SEQ ID NO: 6686 - DNA, 32 bp, Homo sapiens
gaatctgggaggcggagattgcagtgagccga

SEQ ID NO: 6687 - DNA, 32 bp, Homo sapiens
aagatgctggtgaagcaggtgcagtgaggatc

SEQ ID NO: 6688 - DNA, 32 bp, Homo sapiens
agcctcccgagtagctgggattacagcctgaa

SEQ ID NO: 6689 - DNA, 32 bp, Homo sapiens
cacgaggggcggcggcagctgtggaagctcag

SEQ ID NO: 6690 - DNA, 32 bp, Homo sapiens
gaagttcaacatcactgatagttagagaactg

SEQ ID NO: 6691 - DNA, 32 bp, Homo sapiens
cggtcatcacccagcctctgagagcagttact

SEQ ID NO: 6692 - DNA, 32 bp, Homo sapiens
atcaccctcttcagactggagtcagtgggaac

SEQ ID NO: 6693 - DNA, 32 bp, Homo sapiens
tctcactctggcgctctggagtgcagtggtgt

SEQ ID NO: 6694 - DNA, 32 bp, Homo sapiens
tataataatttccaagcggtagattatgtggc

SEQ ID NO: 6695 - DNA, 32 bp, Homo sapiens
gggagaggaagaggagtcggaagggaggcggg

SEQ ID NO: 6696 - DNA, 32 bp, Homo sapiens
tgaagaggaagaggaggacagtgatgaagatt

SEQ ID NO: 6697 - DNA, 32 bp, Homo sapiens
cttaactctgcagctttcaagctcatctgtta

SEQ ID NO: 6698 - DNA, 32 bp, Homo sapiens
accaggtttcttctccccataccacgttgtgc

SEQ ID NO: 6699 - DNA, 24 bp, Homo sapiens
tcacgcctgtattcccagcagttt

SEQ ID NO: 6700 - DNA, 23 bp, Homo sapiens
gacaaaatttaattcattcctca

SEQ ID NO: 6701 - DNA, 32 bp, Homo sapiens
taactgcatcttccactcagtcactacaaaaa

SEQ ID NO: 6702 - DNA, 32 bp, Homo sapiens
attattgacccatagtgacaccagttttggga

SEQ ID NO: 6703 - DNA, 23 bp, Homo sapiens
tggcgctgtctcggctcactgca

SEQ ID NO: 6704 - DNA, 32 bp, Homo sapiens
tgcctcagagccggtcctcagagaccacgaag

SEQ ID NO: 6705 - DNA, 21 bp, Homo sapiens
ccaggccctaagccagcgtca

SEQ ID NO: 6706 - DNA, 32 bp, Homo sapiens
gaaggctctgaactgagccactggggaaggga

SEQ ID NO: 6707 - DNA, 32 bp, Homo sapiens
ttgagacggagtttccctctgttgcccaggct

SEQ ID NO: 6708 - DNA, 23 bp, Homo sapiens
tggcacggtctcacctcactgca

SEQ ID NO: 6709 - DNA, 32 bp, Homo sapiens
catctttgttggcgatctgagtgcagtgtggc

SEQ ID NO: 6710 - DNA, 32 bp, Homo sapiens
cagctgcagcccaggcaggagcagtcgccttt

SEQ ID NO: 6711 - DNA, 23 bp, Homo sapiens
ctgaccaacatggtgaaacctca

SEQ ID NO: 6712 - DNA, 32 bp, Homo sapiens
cagagcaggaggcagagcccgcgggaagctcg

SEQ ID NO: 6713 - DNA, 32 bp, Homo sapiens
acaggagtcagaggctggagtgcaatggcgtg

SEQ ID NO: 6714 - DNA, 32 bp, Homo sapiens
cggctggtgactgatggatgggtagtgggctg

SEQ ID NO: 6715 - DNA, 32 bp, Homo sapiens
atctcctggacgcagaggtgacagtgggagct

SEQ ID NO: 6716 - DNA, 32 bp, Homo sapiens
tgaagacagaggcagagattggagtgacgcat

SEQ ID NO: 6717 - DNA, 32 bp, Homo sapiens
gagcccgggaggcggaggcgggaggcggcggc

SEQ ID NO: 6718 - DNA, 32 bp, Homo sapiens
acctttgcctccctagttcaagcgattttcct

SEQ ID NO: 6719 - DNA, 32 bp, Homo sapiens
gcctccaactcctgggctcaagcaatcctctc

SEQ ID NO: 6720 - DNA, 32 bp, Homo sapiens
aaagccacaagtgcctccaaagccattacacc

SEQ ID NO: 6721 - DNA, 32 bp, Homo sapiens
aacctccacctcctggttcaagcgattctcag

SEQ ID NO: 6722 - DNA, 32 bp, Homo sapiens
tagacagaagaggaagaaagaacagatgttca

SEQ ID NO: 6723 - DNA, 32 bp, Homo sapiens
ctgggctcaagcgagcctcccacctcggtctt

SEQ ID NO: 6724 - DNA, 32 bp, Homo sapiens
gtcttcaactcctgacctcaagcaattgtcct

SEQ ID NO: 6725 - DNA, 24 bp, Homo sapiens
tcatgcccgtaattctcacatttt

SEQ ID NO: 6726 - DNA, 32 bp, Homo sapiens
aaagggagggaaggagaaagaatgggaataaa

SEQ ID NO: 6727 - DNA, 32 bp, Homo sapiens
gattggagttggggagaaagaagacagattag

SEQ ID NO: 6728 - DNA, 32 bp, Homo sapiens
ctagagcctcaaggtctcccagtccagaaaca

SEQ ID NO: 6729 - DNA, 32 bp, Homo sapiens
atgaagccgacgaggggctcagtctaggggaa

SEQ ID NO: 6730 - DNA, 19 bp, Homo sapiens
tctgaagaactgccaatgc

SEQ ID NO: 6731 - DNA, 32 bp, Homo sapiens
tgaggccattcctcgtcatctaggaggggtct

SEQ ID NO: 6732 - DNA, 23 bp, Homo sapiens
tccaggccagtttgaagactaca

SEQ ID NO: 6733 - DNA, 32 bp, Homo sapiens
tgggaatctgagatatgatcccagaaaacatc

SEQ ID NO: 6734 - DNA, 32 bp, Homo sapiens
taggaagttgtgtcagaggagtgcagtcatct

SEQ ID NO: 6735 - DNA, 32 bp, Homo sapiens
ctcttgttgcccaggctgaagtgcaatgttgt

SEQ ID NO: 6736 - DNA, 32 bp, Homo sapiens
ttgggacagagtttcactcttgttgcccaggc

SEQ ID NO: 6737 - DNA, 32 bp, Homo sapiens
aatttttgcccagtctgcctgttgtggggctc

SEQ ID NO: 6738 - DNA, 32 bp, Homo sapiens
gctgtgttgccaaggctggagtgcaggccgcg

SEQ ID NO: 6739 - DNA, 32 bp, Homo sapiens
acagagtcacccaggctggagtgcagtggtga

SEQ ID NO: 6740 - DNA, 32 bp, Homo sapiens
gtacatgggaggcatgtgtgtgatgtgtacac

SEQ ID NO: 6741 - DNA, 32 bp, Homo sapiens
gaatcccggaggcagaggccatgctgaccgca

SEQ ID NO: 6742 - DNA, 32 bp, Homo sapiens
atatcccacatcctggatctttgttgggtatt

SEQ ID NO: 6743 - DNA, 32 bp, Homo sapiens
gctctgtcacccaggctggagtgcaatggtgc

SEQ ID NO: 6744 - DNA, 32 bp, Homo sapiens
gtgaatgggccacgtgcccccacgctggatac

SEQ ID NO: 6745 - DNA, 32 bp, Homo sapiens
gtcaagaccaagggcctcctggaaacaccagc

SEQ ID NO: 6746 - DNA, 26 bp, Homo sapiens
tttgcaattgtcacaactaggagagg

SEQ ID NO: 6747 - DNA, 20 bp, Homo sapiens
tgctataatcctagcacttt

SEQ ID NO: 6748 - DNA, 32 bp, Homo sapiens
gaaaggggaaaggaagaaagaaggagagcagg

SEQ ID NO: 6749 - DNA, 32 bp, Homo sapiens
aaactgctcaatcaaaagaatatttcaactct

SEQ ID NO: 6750 - DNA, 18 bp, Homo sapiens
ggcgaagcagttgtgctt

SEQ ID NO: 6751 - DNA, 31 bp, Homo sapiens
ttggccgacaacacagagaggagggggagct

SEQ ID NO: 6752 - DNA, 32 bp, Homo sapiens
gaacctgggaggcggaggttgcaatgagccga

SEQ ID NO: 6753 - DNA, 32 bp, Homo sapiens
cactctgtcgccaggctggagtgcagtggcgt

SEQ ID NO: 6754 - DNA, 20 bp, Homo sapiens
ccaatatggtgaaacccgtc

SEQ ID NO: 6755 - DNA, 32 bp, Homo sapiens
aaacccaggtggcggaggttgcagtgagccga

SEQ ID NO: 6756 - DNA, 32 bp, Homo sapiens
gaacctgggaggcgcaggttgcagggaggcgg

SEQ ID NO: 6757 - DNA, 32 bp, Homo sapiens
gaacctgagaggcggaggttgcagtgagccga

SEQ ID NO: 6758 - DNA, 28 bp, Homo sapiens
tgttttgtaagtgctgctatatctatcc

SEQ ID NO: 6759 - DNA, 32 bp, Homo sapiens
atgctgccaagtgccatttggggtcagcatcc

SEQ ID NO: 6760 - DNA, 32 bp, Homo sapiens
gagcccaggaggttgaggctgcagtgaggtat

SEQ ID NO: 6761 - DNA, 32 bp, Homo sapiens
tagaaacgtggctttgggctgtggaaacgctg

SEQ ID NO: 6762 - DNA, 32 bp, Homo sapiens
cctggctcaagtgatcctcccacctcagcctt

SEQ ID NO: 6763 - DNA, 32 bp, Homo sapiens
cttggctcaagtgattctcccaccttagcctc

SEQ ID NO: 6764 - DNA, 32 bp, Homo sapiens
agcctcctaagtagctgggattacaggaaatg

SEQ ID NO: 6765 - DNA, 32 bp, Homo sapiens
aagggaggggagcaagaaagaaggcgagagag

SEQ ID NO: 6766 - DNA, 32 bp, Homo sapiens
cccagggggttagaggaggggtgaagattggg

SEQ ID NO: 6767 - DNA, 32 bp, Homo sapiens
ttaagagaggcagaatcttgagcttgaggcac

SEQ ID NO: 6768 - DNA, 32 bp, Homo sapiens
tcctggcctcaagcaatccttctgccttggcc

SEQ ID NO: 6769 - DNA, 31 bp, Homo sapiens
taagccaacaacaacagaacagggtggagtg

SEQ ID NO: 6770 - DNA, 32 bp, Homo sapiens
atgtggcaggagaaagaaagaaaacgggccga

SEQ ID NO: 6771 - DNA, 20 bp, Homo sapiens
tcctccatcaattggcagaa

SEQ ID NO: 6772 - DNA, 19 bp, Homo sapiens
gcaaatgcatgatttctct

SEQ ID NO: 6773 - DNA, 32 bp, Homo sapiens
ctagtgttttctgatgaacacagagtctgcat

SEQ ID NO: 6774 - DNA, 32 bp, Homo sapiens
cctctgccgagcctgcatcactgtgagcaaca

SEQ ID NO: 6775 - DNA, 31 bp, Homo sapiens
agtgaaatgctgctgctgccatttcaactgt

SEQ ID NO: 6776 - DNA, 32 bp, Homo sapiens
gttctaaggctgctgctaattacagcccccaa

SEQ ID NO: 6777 - DNA, 32 bp, Homo sapiens
gctccctgtcttctgtcagcctcagggcatcc

SEQ ID NO: 6778 - DNA, 20 bp, Homo sapiens
ccactcccggcctaggcacc

SEQ ID NO: 6779 - DNA, 32 bp, Homo sapiens
cctgtggatacttggcttttctcttgtgggca

SEQ ID NO: 6780 - DNA, 32 bp, Homo sapiens
ctcttgttgcccaggctggagtgcaatggtat

SEQ ID NO: 6781 - DNA, 32 bp, Homo sapiens
cactccgttgccaggctggagtgctgtggcgc

SEQ ID NO: 6782 - DNA, 32 bp, Homo sapiens
agctctgtcaccaggctggagtgcagtggtgc

SEQ ID NO: 6783 - DNA, 32 bp, Homo sapiens
cgccctgcctccatttaccttgtgatatctta

SEQ ID NO: 6784 - DNA, 32 bp, Homo sapiens
aagcagtgaaaacaggcttctactcaagtgaa

SEQ ID NO: 6785 - DNA, 32 bp, Homo sapiens
cttaaggaagagaccctgtgagtctgacaata

SEQ ID NO: 6786 - DNA, 32 bp, Homo sapiens
gaacgtgggaggcagaggttgcagtgagtgga

SEQ ID NO: 6787 - DNA, 32 bp, Homo sapiens
gaacccaggagatggaggttgcagtgagccaa

SEQ ID NO: 6788 - DNA, 32 bp, Homo sapiens
gacccctgcccaggaagagttcactggtcgct

SEQ ID NO: 6789 - DNA, 32 bp, Homo sapiens
gccttgaattcctgggctcgagcggttctcct

SEQ ID NO: 6790 - DNA, 32 bp, Homo sapiens
ctactcgggaggctgaggcaggagaatcgcct

SEQ ID NO: 6791 - DNA, 32 bp, Homo sapiens
gataggaggaggcagaggggtgcctggagttt

SEQ ID NO: 6792 - DNA, 32 bp, Homo sapiens
agattcccgagtagctgggattacagatgtgc

SEQ ID NO: 6793 - DNA, 32 bp, Homo sapiens
ctgacttcaagtgatctgcccacctctgcctc

SEQ ID NO: 6794 - DNA, 32 bp, Homo sapiens
gtcctcatgcctgtatcccagcactttgggag

SEQ ID NO: 6795 - DNA, 32 bp, Homo sapiens
taatggttttgttggggctcttaacttgcaag

SEQ ID NO: 6796 - DNA, 32 bp, Homo sapiens
ggcccgcaggcaaggtctcccactgcagggct

SEQ ID NO: 6797 - DNA, 32 bp, Homo sapiens
ctgggctcaagcagtcctcccacctcagtctc

SEQ ID NO: 6798 - DNA, 32 bp, Homo sapiens
ctgggctcaagcaatcctcctgcctcagcctc

SEQ ID NO: 6799 - DNA, 24 bp, Homo sapiens
tcacgcctgaaatctcagcacttt

SEQ ID NO: 6800 - DNA, 32 bp, Homo sapiens
ggaaatagaagagcagaagcaaaagcaattgg

SEQ ID NO: 6801 - DNA, 32 bp, Homo sapiens
agggcctgtccctactgagagtgcagggaact

SEQ ID NO: 6802 - DNA, 32 bp, Homo sapiens
tctacatctgcagcttgaggttagcctcatat

SEQ ID NO: 6803 - DNA, 32 bp, Homo sapiens
cctccatccctgtcccccatcttggtgctgaa

SEQ ID NO: 6804 - DNA, 32 bp, Homo sapiens
cccaatgtcctctgcaccatctgggcttcagc

SEQ ID NO: 6805 - DNA, 23 bp, Homo sapiens
tgacatgatctcagctcactgca

SEQ ID NO: 6806 - DNA, 32 bp, Homo sapiens
cagttacctaacctatttcacatgggcgtttt

SEQ ID NO: 6807 - DNA, 32 bp, Homo sapiens
cacagatgtcgagacatctcccatggatttgt

SEQ ID NO: 6808 - DNA, 32 bp, Homo sapiens
ggtgaagagcactacagtgactgtgaatatat

SEQ ID NO: 6809 - DNA, 18 bp, Homo sapiens
cagagaagttccccaccc

SEQ ID NO: 6810 - DNA, 32 bp, Homo sapiens
gacctagagccagtagaagctctcacagtgag

SEQ ID NO: 6811 - DNA, 32 bp, Homo sapiens
ggtctgtcgcccaggctggagtgcagtagcac

SEQ ID NO: 6812 - DNA, 32 bp, Homo sapiens
ctcctgttacccaggctggaggacagtgatgt

SEQ ID NO: 6813 - DNA, 32 bp, Homo sapiens
ctgttaagcccttgaaatatagctagtgtgac

SEQ ID NO: 6814 - DNA, 32 bp, Homo sapiens
cctggatggtctcgattttctgatcttatgat

SEQ ID NO: 6815 - DNA, 32 bp, Homo sapiens
tgggaagaacaacaggaaaccaaggtctgacc

SEQ ID NO: 6816 - DNA, 32 bp, Homo sapiens
cctctgtctcctaagctggagtgcagtggcat

SEQ ID NO: 6817 - DNA, 32 bp, Homo sapiens
gaacccaggaggcggagcttgcagtgagcaga

SEQ ID NO: 6818 - DNA, 32 bp, Homo sapiens
agaacttaagacctgattctagcaataaacgt

SEQ ID NO: 6819 - DNA, 32 bp, Homo sapiens
ttttagcatgatgatggatggatggactggag

SEQ ID NO: 6820 - DNA, 32 bp, Homo sapiens
gagatgtcggccaggtgctcccattggggttt

SEQ ID NO: 6821 - DNA, 32 bp, Homo sapiens
aaaatccagttgacctggacagtattatatgt

SEQ ID NO: 6822 - DNA, 32 bp, Homo sapiens
gcacagtgtgagcccgcccccacgtcgtgggg

SEQ ID NO: 6823 - DNA, 32 bp, Homo sapiens
caggtcaaggaaggcatcctgtggaagtaaca

SEQ ID NO: 6824 - DNA, 32 bp, Homo sapiens
ctggcctcaagcaatcctcccaccttagcctc

SEQ ID NO: 6825 - DNA, 32 bp, Homo sapiens
tctcccccaatctcctcagccacctcaaatca

SEQ ID NO: 6826 - DNA, 32 bp, Homo sapiens
ggctcatgcctgtaatcccagcacttttcgga

SEQ ID NO: 6827 - DNA, 32 bp, Homo sapiens
caggagcgaacaggaacaggaaaacaaatggc

SEQ ID NO: 6828 - DNA, 32 bp, Homo sapiens
agaagaggaagaggaaagaaagacaagtcagg

SEQ ID NO: 6829 - DNA, 32 bp, Homo sapiens
ctgacctcaggtaatcctcccacctcagcctc

SEQ ID NO: 6830 - DNA, 19 bp, Homo sapiens
gctggagtgtgactggaaa

SEQ ID NO: 6831 - DNA, 32 bp, Homo sapiens
tcaatgcccacttagatctcccagaaatagca

SEQ ID NO: 6832 - DNA, 32 bp, Homo sapiens
aggtcggtttgggtttgaattctgcctcttct

SEQ ID NO: 6833 - DNA, 32 bp, Homo sapiens
gtgtcccacagaacttcccactgtggatctgt

SEQ ID NO: 6834 - DNA, 32 bp, Homo sapiens
cccccatggagtttggtgtgcttgcctttggc

SEQ ID NO: 6835 - DNA, 32 bp, Homo sapiens
ggctgccatccctcggggcccaggccctcacc

SEQ ID NO: 6836 - DNA, 32 bp, Homo sapiens
cgctgtattgccagactggagtgcagtggcgt

SEQ ID NO: 6837 - DNA, 32 bp, Homo sapiens
agcagcacattcaaccatttgttttcagtcag

SEQ ID NO: 6838 - DNA, 32 bp, Homo sapiens
cctcatgcttcacttagccatggtggacccag

SEQ ID NO: 6839 - DNA, 32 bp, Homo sapiens
atgcagaaagagatattctgtgatagatatat

SEQ ID NO: 6840 - DNA, 32 bp, Homo sapiens
gctctgtcgtccaggctggagtgccgtggcgt

SEQ ID NO: 6841 - DNA, 32 bp, Homo sapiens
gttctgtcacccaggctggggtgcagtggcgt

SEQ ID NO: 6842 - DNA, 32 bp, Homo sapiens
gaaggcggcaggcagagaagtggagtgactat

SEQ ID NO: 6843 - DNA, 32 bp, Homo sapiens
gctgggcagaggcagaggtcagcactggccat

SEQ ID NO: 6844 - DNA, 32 bp, Homo sapiens
ttattgatacaacaggattttcaagttattca

SEQ ID NO: 6845 - DNA, 32 bp, Homo sapiens
cccgcctccagtgcccttctttccaaaacagc

SEQ ID NO: 6846 - DNA, 32 bp, Homo sapiens
gaatctgggaggtggaggttgcagtgagccaa

SEQ ID NO: 6847 - DNA, 32 bp, Homo sapiens
gaatccaggaggtggaggttgcagtgagctga

SEQ ID NO: 6848 - DNA, 32 bp, Homo sapiens
acctccgactccctggttcaagcgattctcct

SEQ ID NO: 6849 - DNA, 18 bp, Homo sapiens
caggaagaattgcttgaa

SEQ ID NO: 6850 - DNA, 32 bp, Homo sapiens
gacagctacctgcattgtagaaccttttctta

SEQ ID NO: 6851 - DNA, 32 bp, Homo sapiens
cttggctattgtccatgctcccagaatcaagc

SEQ ID NO: 6852 - DNA, 22 bp, Homo sapiens
aaaggaaagggggtcacgcaca

SEQ ID NO: 6853 - DNA, 31 bp, Homo sapiens
caaacaaacaaaacaactagctagggatggt

SEQ ID NO: 6854 - DNA, 18 bp, Homo sapiens
caggaactgctgcctgag

SEQ ID NO: 6855 - DNA, 21 bp, Homo sapiens
atcttcatacatcaccacacc

SEQ ID NO: 6856 - DNA, 32 bp, Homo sapiens
tttcctcagggatccaccacagtctaggccag

SEQ ID NO: 6857 - DNA, 32 bp, Homo sapiens
gacacatagtaatctctaaggtgcaaaacaca

SEQ ID NO: 6858 - DNA, 32 bp, Homo sapiens
gttctgttgtccaggatggagtgcagtggttg

SEQ ID NO: 6859 - DNA, 32 bp, Homo sapiens
cggtcaccagttctgccgtgcgatggggcctc

SEQ ID NO: 6860 - DNA, 21 bp, Homo sapiens
gcgcaatcttggctcactgca

SEQ ID NO: 6861 - DNA, 32 bp, Homo sapiens
gaacccgggaggcggagcttgcagtgagccca

SEQ ID NO: 6862 - DNA, 32 bp, Homo sapiens
ttgcctactatcctgaatttgcctactatcta

SEQ ID NO: 6863 - DNA, 32 bp, Homo sapiens
tctctcacccaggcctgaagtgcagtggcatg

SEQ ID NO: 6864 - DNA, 28 bp, Homo sapiens
gggtgcccgggatgagcctcatccggaa

SEQ ID NO: 6865 - DNA, 32 bp, Homo sapiens
cgactcccagaggcccttaaacagcatcttca

SEQ ID NO: 6866 - DNA, 32 bp, Homo sapiens
gctctgtcgcccaggctcgagtgcagtggcat

SEQ ID NO: 6867 - DNA, 32 bp, Homo sapiens
gcttctctcctcctgctggagtgccagtccct

SEQ ID NO: 6868 - DNA, 32 bp, Homo sapiens
ctctgtcgctcaggctggagagcggtggtgca

SEQ ID NO: 6869 - DNA, 32 bp, Homo sapiens
gctagatggtctcaatctcctgatctcgtggt

SEQ ID NO: 6870 - DNA, 32 bp, Homo sapiens
gctctgtcggccaggctggagtgcagtggcat

SEQ ID NO: 6871 - DNA, 32 bp, Homo sapiens
gacagctcaaaccatctttggctactgtgccc

SEQ ID NO: 6872 - DNA, 32 bp, Homo sapiens
tgcctcccaagcaatcctcccacctcagcctc

SEQ ID NO: 6873 - DNA, 32 bp, Homo sapiens
ccgggctcaagtgaccctcccacctcagcctc

SEQ ID NO: 6874 - DNA, 18 bp, Homo sapiens
cccaccctccccatgcct

SEQ ID NO: 6875 - DNA, 24 bp, Homo sapiens
tcacacctgtaatccaagcacttt

SEQ ID NO: 6876 - DNA, 32 bp, Homo sapiens
gaacctgggagcaggaggttgcagtgagccga

SEQ ID NO: 6877 - DNA, 32 bp, Homo sapiens
gagagctcacccaggcgggggtgttgtgggta

SEQ ID NO: 6878 - DNA, 32 bp, Homo sapiens
gttagtgagagtttcactcttgttgcctaggc

SEQ ID NO: 6879 - DNA, 24 bp, Homo sapiens
ctgcaatgactgcagggctgggaa

SEQ ID NO: 6880 - DNA, 32 bp, Homo sapiens
accaagaagaattgaggctgcttgggaggaag

SEQ ID NO: 6881 - DNA, 32 bp, Homo sapiens
ctctgtcacccgggctggagtgcagtggtgcg

SEQ ID NO: 6882 - DNA, 32 bp, Homo sapiens
gttgtatgttcgtgctggagttttgttggtgt

SEQ ID NO: 6883 - DNA, 32 bp, Homo sapiens
caccaagaacaatgctggagtgcagtggcgtg

SEQ ID NO: 6884 - DNA, 32 bp, Homo sapiens
caatggtgcccaggctggagtgcagtggcgtg

SEQ ID NO: 6885 - DNA, 32 bp, Homo sapiens
ctctgttgccctggctggagtgcagtagagtg

SEQ ID NO: 6886 - DNA, 32 bp, Homo sapiens
ctctgtcgcccaggctggaatgcagtggtgca

SEQ ID NO: 6887 - DNA, 16 bp, Homo sapiens
gcccctggctccaggt

SEQ ID NO: 6888 - DNA, 32 bp, Homo sapiens
gcggccccgagtgccctgtgaaatcagctcag

SEQ ID NO: 6889 - DNA, 32 bp, Homo sapiens
gggtacagatgggcataggtgcagtgagtgca

SEQ ID NO: 6890 - DNA, 32 bp, Homo sapiens
aacgcagcgccagcagcatctcatctaccctc

SEQ ID NO: 6891 - DNA, 25 bp, Homo sapiens
acaagcatgagccaccacacctggc

SEQ ID NO: 6892 - DNA, 32 bp, Homo sapiens
tccactctgcttctctgacttctgcctggaga

SEQ ID NO: 6893 - DNA, 32 bp, Homo sapiens
agttccttgcaacttagccatgatgtgagtgg

SEQ ID NO: 6894 - DNA, 32 bp, Homo sapiens
ttgagatggagtttcgctcttgttgcccaggc

SEQ ID NO: 6895 - DNA, 32 bp, Homo sapiens
ttgagacggagttttgctcttgttgcccaggc

SEQ ID NO: 6896 - DNA, 32 bp, Homo sapiens
ctctgtcgcccaggctggagtgcagtgatgca

SEQ ID NO: 6897 - DNA, 32 bp, Homo sapiens
tgctatagtgtttggcttattttccatcccag

SEQ ID NO: 6898 - DNA, 32 bp, Homo sapiens
actgcagcgggaagtggcttctctccagaata

SEQ ID NO: 6899 - DNA, 32 bp, Homo sapiens
agcctccccagtagctgggattacaggcgccg

SEQ ID NO: 6900 - DNA, 32 bp, Homo sapiens
tgcaaggagaggcagaggccagtgcttgcgcg

SEQ ID NO: 6901 - DNA, 32 bp, Homo sapiens
ctccagtgctcaggctggcttgggctgcatga

SEQ ID NO: 6902 - DNA, 32 bp, Homo sapiens
ctctgtcgcccaggctggggtgcagtggcgcc

SEQ ID NO: 6903 - DNA, 32 bp, Homo sapiens
ttgtcctttggcctttcacttctgccttctgt

SEQ ID NO: 6904 - DNA, 32 bp, Homo sapiens
tgactggcagggggagaaagtaaacagagttg

SEQ ID NO: 6905 - DNA, 32 bp, Homo sapiens
gtcttgaattcctgggctcaagcaattcttcc

SEQ ID NO: 6906 - DNA, 32 bp, Homo sapiens
gctctgtcacccaggctggagtaccggtggtg

SEQ ID NO: 6907 - DNA, 32 bp, Homo sapiens
ggaaaggagaaaggagaaagaaggtgaagtct

SEQ ID NO: 6908 - DNA, 32 bp, Homo sapiens
tctgtggccctctcttaatgccacggcagcca

SEQ ID NO: 6909 - DNA, 32 bp, Homo sapiens
tggttgttgcccaggctggagtgcagtggcgc

SEQ ID NO: 6910 - DNA, 32 bp, Homo sapiens
tggttccctggcaggctggagggcaggagctg

SEQ ID NO: 6911 - DNA, 32 bp, Homo sapiens
tccctctgtgccaggccagagtgcagtggtgc

SEQ ID NO: 6912 - DNA, 32 bp, Homo sapiens
taggaagaaagaggagacaaggacagacaaat

SEQ ID NO: 6913 - DNA, 28 bp, Homo sapiens
ccaggcccagcatctgcctcaccgtggc

SEQ ID NO: 6914 - DNA, 32 bp, Homo sapiens
cctcctgcttcctgggttcaagcgattctcct

SEQ ID NO: 6915 - DNA, 32 bp, Homo sapiens
gatcctaatacttggccatctccacacaagtt

SEQ ID NO: 6916 - DNA, 32 bp, Homo sapiens
taaagggatacttggaacaactttatgccaat

SEQ ID NO: 6917 - DNA, 32 bp, Homo sapiens
tcctgagcagcctcttttctaggatcaatatg

SEQ ID NO: 6918 - DNA, 32 bp, Homo sapiens
cctatgtcacccaggctgtggtgcagtaagcc

SEQ ID NO: 6919 - DNA, 32 bp, Homo sapiens
ggtcggtcacccagacagctctgtggaggcag

SEQ ID NO: 6920 - DNA, 32 bp, Homo sapiens
tactttagaagaggataatggataaaatcaat

SEQ ID NO: 6921 - DNA, 27 bp, Homo sapiens
ccatggggtcgcgcagctcccacgccg

SEQ ID NO: 6922 - DNA, 32 bp, Homo sapiens
tctagttgcccacactagagtgcaatggcgca

SEQ ID NO: 6923 - DNA, 32 bp, Homo sapiens
acctgtgtatttgcccctgagcactttccttt

SEQ ID NO: 6924 - DNA, 32 bp, Homo sapiens
ctcacgtcaggcctttgagaattctttccccc

SEQ ID NO: 6925 - DNA, 22 bp, Homo sapiens
atgcctgtaatcccagcacttt

SEQ ID NO: 6926 - DNA, 32 bp, Homo sapiens
gagggaagaagaggagaggggaggggacctgc

SEQ ID NO: 6927 - DNA, 32 bp, Homo sapiens
cagcctgggaggtcaaggctgcagtgagctgt

SEQ ID NO: 6928 - DNA, 32 bp, Homo sapiens
ggtgggcctctgccttctcttctgtttggcca

SEQ ID NO: 6929 - DNA, 32 bp, Homo sapiens
agatgaggaggcctccagaaatggcagaattc

SEQ ID NO: 6930 - DNA, 24 bp, Homo sapiens
tcacacctttaatcctagcacttt

SEQ ID NO: 6931 - DNA, 32 bp, Homo sapiens
aatgtagtctgccttgaaaagtctttcagctg

SEQ ID NO: 6932 - DNA, 16 bp, Homo sapiens
agagaagctccagctc

SEQ ID NO: 6933 - DNA, 32 bp, Homo sapiens
gaggagtaggagccggtctcccagaaggcgga

SEQ ID NO: 6934 - DNA, 32 bp, Homo sapiens
gctctgtcgcccaggctggagtgcagtggtga

SEQ ID NO: 6935 - DNA, 32 bp, Homo sapiens
ccccgcaaaatcaggcttgagtgcagtggcgc

SEQ ID NO: 6936 - DNA, 32 bp, Homo sapiens
attgtgttccccaggctgaagtgcagtggcat

SEQ ID NO: 6937 - DNA, 32 bp, Homo sapiens
gatcctgggaggcagaggttgtagtgagccga

SEQ ID NO: 6938 - DNA, 32 bp, Homo sapiens
agcctcctgagtagctgggattacaggaccag

SEQ ID NO: 6939 - DNA, 32 bp, Homo sapiens
gttcgggttaagtgatgaaaatggcagtggtg

SEQ ID NO: 6940 - DNA, 24 bp, Homo sapiens
tcatgcctgtaagcccaacacttt

SEQ ID NO: 6941 - DNA, 32 bp, Homo sapiens
gaacccaagaggcagaggatgcaatgagccaa

SEQ ID NO: 6942 - DNA, 32 bp, Homo sapiens
ggacccctgctgctgctcctgctcagctcctg

SEQ ID NO: 6943 - DNA, 23 bp, Homo sapiens
ccaagctcaccagccctgcgcca

SEQ ID NO: 6944 - DNA, 32 bp, Homo sapiens
ggtgcctctgcagagagatccctgcctgggac

SEQ ID NO: 6945 - DNA, 32 bp, Homo sapiens
ggtggtgaacagggtggatgtggcgtggctcc

SEQ ID NO: 6946 - DNA, 32 bp, Homo sapiens
atcaaggctttaagagactcactgtgatgcct

SEQ ID NO: 6947 - DNA, 32 bp, Homo sapiens
aggagacggagtttcactgttgttgcccaggc

SEQ ID NO: 6948 - DNA, 32 bp, Homo sapiens
aagcagcaggttcgagtctccacgccgtcagc

SEQ ID NO: 6949 - DNA, 32 bp, Homo sapiens
tgtgtgccaatggtggatctttgctactgaat

SEQ ID NO: 6950 - DNA, 32 bp, Homo sapiens
aaagagaaactatctatttgcaccttaaaaga

SEQ ID NO: 6951 - DNA, 32 bp, Homo sapiens
atgttagtcaggctggtctccacctcaggtga

SEQ ID NO: 6952 - DNA, 32 bp, Homo sapiens
ctcctctcgtcctcttctcttttcctcattct

SEQ ID NO: 6953 - DNA, 32 bp, Homo sapiens
tccaaggatgaatcctggaaattgcagttagc

SEQ ID NO: 6954 - DNA, 32 bp, Homo sapiens
gcaaaggaggggaaacaatgaaaacaaataaa

SEQ ID NO: 6955 - DNA, 32 bp, Homo sapiens
ttatgtcagccagtgtttcaggcacaggaagt

SEQ ID NO: 6956 - DNA, 32 bp, Homo sapiens
agggcctagctttcatttgacacacagactac

SEQ ID NO: 6957 - DNA, 32 bp, Homo sapiens
ggatactttgcagcttcctatgtttgagtgac

SEQ ID NO: 6958 - DNA, 32 bp, Homo sapiens
gccatgttgcccaggctggaagtgtctatgtt

SEQ ID NO: 6959 - DNA, 20 bp, Homo sapiens
ccaacaggtgaaaccccatc

SEQ ID NO: 6960 - DNA, 32 bp, Homo sapiens
ctcaacgcgctgctgctgctgctctatcggcc

SEQ ID NO: 6961 - DNA, 32 bp, Homo sapiens
ctgtgtcgcccaggctggagtgcaagtggcat

SEQ ID NO: 6962 - DNA, 32 bp, Homo sapiens
ctgggttgggctggtggatgtggggcctggga

SEQ ID NO: 6963 - DNA, 32 bp, Homo sapiens
tgcggcctgcctattccatctgaatgtcgcat

SEQ ID NO: 6964 - DNA, 32 bp, Homo sapiens
agtctcttgagtagctgagattacaggtacgc

SEQ ID NO: 6965 - DNA, 32 bp, Homo sapiens
attaaaagggtttaagaagaattctttctcag

SEQ ID NO: 6966 - DNA, 32 bp, Homo sapiens
cagcctcccagtagctgggattagaggcatgt

SEQ ID NO: 6967 - DNA, 32 bp, Homo sapiens
agcctcctgagtagctgggattacaggttcct

SEQ ID NO: 6968 - DNA, 32 bp, Homo sapiens
aagagtaggggcctgaatcctgctacaactat

SEQ ID NO: 6969 - DNA, 32 bp, Homo sapiens
gattcttcaagcaatcactatgtcaacagaca

SEQ ID NO: 6970 - DNA, 32 bp, Homo sapiens
atcattcctcctcactaggagcactttgatgt

SEQ ID NO: 6971 - DNA, 24 bp, Homo sapiens
tcacgcctgtaatcccagaatttt

SEQ ID NO: 6972 - DNA, 32 bp, Homo sapiens
acctgacaaagaggaggagctggaggaagcat

SEQ ID NO: 6973 - DNA, 28 bp, Homo sapiens
catcacccaagtgcctgatgcctcaggt

SEQ ID NO: 6974 - DNA, 24 bp, Homo sapiens
tcatgcctgtaatcttatcacttt

SEQ ID NO: 6975 - DNA, 24 bp, Homo sapiens
tcatgcctgtagtcccagcacttt

SEQ ID NO: 6976 - DNA, 24 bp, Homo sapiens
tcatgcctgtaatcccagcgcttt

SEQ ID NO: 6977 - DNA, 24 bp, Homo sapiens
tggcacaatcacagctcactgtag

SEQ ID NO: 6978 - DNA, 32 bp, Homo sapiens
taggaacactcgggatgacaccccttatcaca

SEQ ID NO: 6979 - DNA, 32 bp, Homo sapiens
ggattttgtaggtcctgtttttcccatctgtg

SEQ ID NO: 6980 - DNA, 32 bp, Homo sapiens
gtgaccctgggtgtgaggagacgtggtctgtg

SEQ ID NO: 6981 - DNA, 32 bp, Homo sapiens
cgggaggctgaggcaggagaatctctttctta

SEQ ID NO: 6982 - DNA, 32 bp, Homo sapiens
ccctgacgacatcagtgatacccaaagctgag

SEQ ID NO: 6983 - DNA, 32 bp, Homo sapiens
cctcgccatcttcttctcacagccggaccgga

SEQ ID NO: 6984 - DNA, 32 bp, Homo sapiens
agcaacttggaagaggaaagaaaagaagtcag

SEQ ID NO: 6985 - DNA, 28 bp, Homo sapiens
ctcggcccaagtgagtcctggtccaagg

SEQ ID NO: 6986 - DNA, 32 bp, Homo sapiens
cagggaggagctgcctgttcactgggatcagc

SEQ ID NO: 6987 - DNA, 32 bp, Homo sapiens
acacttctgaggtacggtatctctctccagcc

SEQ ID NO: 6988 - DNA, 19 bp, Homo sapiens
gcgcctcctgcacagcggc

SEQ ID NO: 6989 - DNA, 32 bp, Homo sapiens
tgaaccaggatggggaggttgcagtgagccga

SEQ ID NO: 6990 - DNA, 32 bp, Homo sapiens
tgcctcccgagtagctgggattacaggcatct

SEQ ID NO: 6991 - DNA, 32 bp, Homo sapiens
tacttcaagaagaagaagctgtggaagcccag

SEQ ID NO: 6992 - DNA, 32 bp, Homo sapiens
ttccctccacaagagatataccacctttaaaa

SEQ ID NO: 6993 - DNA, 24 bp, Homo sapiens
tcacgcctgtaacctcagcacttt

SEQ ID NO: 6994 - DNA, 32 bp, Homo sapiens
gggggaggaagaggaggtggagaaggaggggg

SEQ ID NO: 6995 - DNA, 32 bp, Homo sapiens
ggcagctcttgagttatgcactgtgaagaatg

SEQ ID NO: 6996 - DNA, 32 bp, Homo sapiens
gtactgctgctgctgctgctcagggcttcgtg

SEQ ID NO: 6997 - DNA, 32 bp, Homo sapiens
ctcccaccccacctacctcacagggttgttgt

SEQ ID NO: 6998 - DNA, 32 bp, Homo sapiens
cagtcagatgttcttctccttcagcttcggct

SEQ ID NO: 6999 - DNA, 32 bp, Homo sapiens
tctgaaacctcggcctgatctgatctcatgtt

SEQ ID NO: 7000 - DNA, 32 bp, Homo sapiens
ttcataccaacacaggcttcagcacttccttt

SEQ ID NO: 7001 - DNA, 32 bp, Homo sapiens
taggttactttttctctttaagcaattattcc

SEQ ID NO: 7002 - DNA, 32 bp, Homo sapiens
agttgggggaggcagagccagcaggtggacag

SEQ ID NO: 7003 - DNA, 32 bp, Homo sapiens
agcctcctgagtagccaggactatggcatgta

SEQ ID NO: 7004 - DNA, 32 bp, Homo sapiens
agcttcccgagtagctgggattacagatgtga

SEQ ID NO: 7005 - DNA, 32 bp, Homo sapiens
atgtgaggatgaggagacagaaaacaagtagc

SEQ ID NO: 7006 - DNA, 32 bp, Homo sapiens
tgctttccaagtgcaaaactacagacacgcgc

SEQ ID NO: 7007 - DNA, 32 bp, Homo sapiens
tactcggggaggcagggtagcagtgcttccag

SEQ ID NO: 7008 - DNA, 32 bp, Homo sapiens
ccggaccattgagacatttgccaaggaggaac

SEQ ID NO: 7009 - DNA, 32 bp, Homo sapiens
aggttatcaaaccatggagtgatgtggagcta

SEQ ID NO: 7010 - DNA, 32 bp, Homo sapiens
tctgcatgtggtacttctcttttccctcagtt

SEQ ID NO: 7011 - DNA, 32 bp, Homo sapiens
gctcttacgcccaggctggaatgaagtggcat

SEQ ID NO: 7012 - DNA, 32 bp, Homo sapiens
ttgtgtcttccagatgggtaccacagatggct

SEQ ID NO: 7013 - DNA, 24 bp, Homo sapiens
tgccacgatcttggctccctgcag

SEQ ID NO: 7014 - DNA, 32 bp, Homo sapiens
acctccgcctcctgggttcaagcaattctcca

SEQ ID NO: 7015 - DNA, 32 bp, Homo sapiens
ccagcctcaagcgatgctcccacctccacctc

SEQ ID NO: 7016 - DNA, 32 bp, Homo sapiens
cccgggcctcaagcagtccccacctccgagtg

SEQ ID NO: 7017 - DNA, 32 bp, Homo sapiens
gaatggtattgaattggtctgtggaaaattgc

SEQ ID NO: 7018 - DNA, 22 bp, Homo sapiens
aggccatcagctgccatgcaca

SEQ ID NO: 7019 - DNA, 24 bp, Homo sapiens
tcacgcctgcaatcccagcacttt

SEQ ID NO: 7020 - DNA, 28 bp, Homo sapiens
ttcttaaccaaggctgcctcttccaaca

SEQ ID NO: 7021 - DNA, 32 bp, Homo sapiens
ccacctgccctctcttccctgcctgatcaccg

SEQ ID NO: 7022 - DNA, 32 bp, Homo sapiens
ggagattgcccaggatcaagggtgcggtgttg

SEQ ID NO: 7023 - DNA, 32 bp, Homo sapiens
ctctgctgtcaacttcccatctggctcagcat

SEQ ID NO: 7024 - DNA, 32 bp, Homo sapiens
aggagctgagaaaccgagtcactgtgaaaaga

SEQ ID NO: 7025 - DNA, 32 bp, Homo sapiens
tctctctcgccatggttggagtgcagtggtgc

SEQ ID NO: 7026 - DNA, 32 bp, Homo sapiens
caagggtcacccaaatagctgagtgcagtcct

SEQ ID NO: 7027 - DNA, 32 bp, Homo sapiens
agtcccccgagtagctgggattacagatgccc

SEQ ID NO: 7028 - DNA, 32 bp, Homo sapiens
tcttctgcagccacctgctttccagagagatg

SEQ ID NO: 7029 - DNA, 32 bp, Homo sapiens
atctccacctcccggattcaagcagttttcct

SEQ ID NO: 7030 - DNA, 32 bp, Homo sapiens
tcccagcctttgaggccgggtgcagtggctca

SEQ ID NO: 7031 - DNA, 32 bp, Homo sapiens
ccaagctcaagcaatcctcctgcctctgcctc

SEQ ID NO: 7032 - DNA, 32 bp, Homo sapiens
aggcctcaacccctttctcccacccagcccca

SEQ ID NO: 7033 - DNA, 26 bp, Homo sapiens
accacaccttgccatgcagagcacct

SEQ ID NO: 7034 - DNA, 32 bp, Homo sapiens
aaccaaccaagaggaggagaaagatgacccag

SEQ ID NO: 7035 - DNA, 32 bp, Homo sapiens
cctgggaggcggaggaggttgcagtgaactga

SEQ ID NO: 7036 - DNA, 32 bp, Homo sapiens
ttgctccagcccaggctggagtgcagtggcat

SEQ ID NO: 7037 - DNA, 32 bp, Homo sapiens
aataacccagttctgcaccactggtttttgta

SEQ ID NO: 7038 - DNA, 23 bp, Homo sapiens
tggcatgatcttggcttactgca

SEQ ID NO: 7039 - DNA, 32 bp, Homo sapiens
actgtagcgtctgcctgctccctggactcgca

SEQ ID NO: 7040 - DNA, 32 bp, Homo sapiens
ttttagcatgacgactttggaccatgtgattg

SEQ ID NO: 7041 - DNA, 32 bp, Homo sapiens
ccatcaggcatgctctcccccacctctgtcca

SEQ ID NO: 7042 - DNA, 32 bp, Homo sapiens
ggcctcccgagtagctgggactggaggcgtgt

SEQ ID NO: 7043 - DNA, 32 bp, Homo sapiens
aaccttcggagtagctgggatcacagctgcag

SEQ ID NO: 7044 - DNA, 32 bp, Homo sapiens
gaaaacaggaggtggaggttgcagtgagccga

SEQ ID NO: 7045 - DNA, 32 bp, Homo sapiens
cattgtcacccaggctggagtacagtggcatg

SEQ ID NO: 7046 - DNA, 32 bp, Homo sapiens
tctttttgcctaggctggagtgcagtggtaca

SEQ ID NO: 7047 - DNA, 32 bp, Homo sapiens
gaacccgggaggcagagcttgcagtgagccaa

SEQ ID NO: 7048 - DNA, 32 bp, Homo sapiens
gaacccaggaggcagagcttgcagtgagccga

SEQ ID NO: 7049 - DNA, 32 bp, Homo sapiens
gaacccgggaggcagagcttgcggtgagccga

SEQ ID NO: 7050 - DNA, 32 bp, Homo sapiens
aggaaatttgcagcttccaatgcctcttgtct

SEQ ID NO: 7051 - DNA, 20 bp, Homo sapiens
cccctggagctatccgggta

SEQ ID NO: 7052 - DNA, 32 bp, Homo sapiens
gggagcagaagagggatgagggggagcaggag

SEQ ID NO: 7053 - DNA, 32 bp, Homo sapiens
tctgctggagaacttagcccagagctagtgaa

SEQ ID NO: 7054 - DNA, 32 bp, Homo sapiens
cttgtgttccaccttgaatctcacagcgtccc

SEQ ID NO: 7055 - DNA, 32 bp, Homo sapiens
ttgcttgcctgtgacatctctgtggcaggggt

SEQ ID NO: 7056 - DNA, 32 bp, Homo sapiens
gcagatttatgacatccatataagctatctgg

SEQ ID NO: 7057 - DNA, 32 bp, Homo sapiens
tgaggagtgggctcctgctccatgagggacac

SEQ ID NO: 7058 - DNA, 32 bp, Homo sapiens
ctgggctcaagcaatcctctcaccgcagcctc

SEQ ID NO: 7059 - DNA, 32 bp, Homo sapiens
agcgtcctgagtagctgggaccacaggtgccc

SEQ ID NO: 7060 - DNA, 32 bp, Homo sapiens
agcctcctgagtagctgggactacaagcatgc

SEQ ID NO: 7061 - DNA, 32 bp, Homo sapiens
agcttctttgcagcttcctcttctaccatttc

SEQ ID NO: 7062 - DNA, 32 bp, Homo sapiens
cgccagtgagcctcctggaagggcagcaagtt

SEQ ID NO: 7063 - DNA, 32 bp, Homo sapiens
gaacccgggaggcggaggctgcagtgggccgg

SEQ ID NO: 7064 - DNA, 32 bp, Homo sapiens
gtctgcctgctgctgtgcggtagctccagaac

SEQ ID NO: 7065 - DNA, 32 bp, Homo sapiens
ggcctttgctgtggctggagctggacagtgca

SEQ ID NO: 7066 - DNA, 32 bp, Homo sapiens
atgtgctttgtggcttctctttacagctttgt

SEQ ID NO: 7067 - DNA, 32 bp, Homo sapiens
aatgggagaggaggagaatcaatgggatgtgg

SEQ ID NO: 7068 - DNA, 32 bp, Homo sapiens
aggcaccaagttctgtcccccgtagaaatccc

SEQ ID NO: 7069 - DNA, 21 bp, Homo sapiens
cccactgggaccccgacacca

SEQ ID NO: 7070 - DNA, 32 bp, Homo sapiens
gctctgtcgctcaggctggagtgcagtggcgc

SEQ ID NO: 7071 - DNA, 32 bp, Homo sapiens
actctgtcactcaggctggagtgcagtggcgc

SEQ ID NO: 7072 - DNA, 32 bp, Homo sapiens
ggtggttgctgaaggctggagtgggtgtggca

SEQ ID NO: 7073 - DNA, 32 bp, Homo sapiens
gtggcctcaagcaatccttccacctcagactc

SEQ ID NO: 7074 - DNA, 32 bp, Homo sapiens
agactcccgagtagctgggattacaggcacat

SEQ ID NO: 7075 - DNA, 32 bp, Homo sapiens
gtctgccacccaggctggagtccagtggcgtg

SEQ ID NO: 7076 - DNA, 32 bp, Homo sapiens
ctctgtcacccaggctggagtgcactggcttg

SEQ ID NO: 7077 - DNA, 32 bp, Homo sapiens
ttctgtcacacagtctggagtgctgtggtgca

SEQ ID NO: 7078 - DNA, 32 bp, Homo sapiens
ttctgtctcccaggctgaagtgcagtgagtca

SEQ ID NO: 7079 - DNA, 32 bp, Homo sapiens
tttttaaacaaaacatgacaaccttggctttt

SEQ ID NO: 7080 - DNA, 28 bp, Homo sapiens
agcaagcaagttgctgcctattctatag

SEQ ID NO: 7081 - DNA, 32 bp, Homo sapiens
agttatgagaaaggagaaagcttgcaatgcat

SEQ ID NO: 7082 - DNA, 32 bp, Homo sapiens
ctgcctgtgctcaggtcctcagctccatggga

SEQ ID NO: 7083 - DNA, 32 bp, Homo sapiens
atttatgcctgagagattccttgaaaatgcaa

SEQ ID NO: 7084 - DNA, 32 bp, Homo sapiens
attctgttgcccaggctggagtgcagtggcgt

SEQ ID NO: 7085 - DNA, 32 bp, Homo sapiens
actctgtcgtccaggctggagtgcagtggcgc

SEQ ID NO: 7086 - DNA, 32 bp, Homo sapiens
gctctgtcatccaggctggagtgcagtggcgc

SEQ ID NO: 7087 - DNA, 32 bp, Homo sapiens
cctgtctcttcagcttctctgatgcttgaact

SEQ ID NO: 7088 - DNA, 31 bp, Homo sapiens
agacaacacaacacaggaggggataagtacc

SEQ ID NO: 7089 - DNA, 32 bp, Homo sapiens
gtccaatttacaggctggagcagcagctgcat

SEQ ID NO: 7090 - DNA, 32 bp, Homo sapiens
ccacaatcctgagactttcccccgggaggcac

SEQ ID NO: 7091 - DNA, 32 bp, Homo sapiens
tttctcccagtttggcactgtgacacagttca

SEQ ID NO: 7092 - DNA, 32 bp, Homo sapiens
gctcccaaaccatgtcaggaccaccttcctct

SEQ ID NO: 7093 - DNA, 32 bp, Homo sapiens
aaacctattcttagctcacaggccatggagaa

SEQ ID NO: 7094 - DNA, 19 bp, Homo sapiens
gccacctctccacccagga

SEQ ID NO: 7095 - DNA, 19 bp, Homo sapiens
ccatcactgccttcttgaa

SEQ ID NO: 7096 - DNA, 32 bp, Homo sapiens
aggaggtggaggttgaaatgagctgagatcat

SEQ ID NO: 7097 - DNA, 32 bp, Homo sapiens
gtcttggtaggaggagaagaaacacagggaaa

SEQ ID NO: 7098 - DNA, 32 bp, Homo sapiens
tgctcctgtccccactcacaggcccacgcagc

SEQ ID NO: 7099 - DNA, 32 bp, Homo sapiens
gctcggcccaaggcaggagaatctcttgaagc

SEQ ID NO: 7100 - DNA, 32 bp, Homo sapiens
gcctcggcttcctgggctcaggtgattcttcc

SEQ ID NO: 7101 - DNA, 32 bp, Homo sapiens
cactgtcaaccaggccagagtgcagtgaagat

SEQ ID NO: 7102 - DNA, 32 bp, Homo sapiens
ctgtcctcaagtgatcctcccacctcagcctt

SEQ ID NO: 7103 - DNA, 32 bp, Homo sapiens
gctttctggccttcttttcccaccttaggctt

SEQ ID NO: 7104 - DNA, 32 bp, Homo sapiens
tccaaggttgctagcaggaaatggcagagcca

SEQ ID NO: 7105 - DNA, 32 bp, Homo sapiens
tcttgtcactcaggctggagtgcagtggtgtg

SEQ ID NO: 7106 - DNA, 32 bp, Homo sapiens
ctctgtcatctaggctggagtgcagtggtgtg

SEQ ID NO: 7107 - DNA, 32 bp, Homo sapiens
ctctcttgcccaggctggagtgcaatggcacg

SEQ ID NO: 7108 - DNA, 32 bp, Homo sapiens
ggaatcccctaggagccttcagtctgggagaa

SEQ ID NO: 7109 - DNA, 32 bp, Homo sapiens
tttctccccaaaactggtaatgccaaccttat

SEQ ID NO: 7110 - DNA, 21 bp, Homo sapiens
ctgaccaacatgacaaaaccc

SEQ ID NO: 7111 - DNA, 29 bp, Homo sapiens
ttgagacagagtttcactcttgttgcctg

SEQ ID NO: 7112 - DNA, 32 bp, Homo sapiens
cgattgcaaagcctcctctcccagagacccct

SEQ ID NO: 7113 - DNA, 32 bp, Homo sapiens
ttttgtcacccaggctggagtgcagtggtgtg

SEQ ID NO: 7114 - DNA, 32 bp, Homo sapiens
ctcttgttgcccacgctggagtgcaatggtgc

SEQ ID NO: 7115 - DNA, 32 bp, Homo sapiens
accgctccagttctcatcatctcccaggcaga

SEQ ID NO: 7116 - DNA, 32 bp, Homo sapiens
agcctcctgagtagctgggactacaggtatgc

SEQ ID NO: 7117 - DNA, 32 bp, Homo sapiens
gaacccgggagatggcgcttgcagtgagctga

SEQ ID NO: 7118 - DNA, 32 bp, Homo sapiens
ctgcttgggaggctgaggttgcaggatcgctt

SEQ ID NO: 7119 - DNA, 32 bp, Homo sapiens
tttgctgggcactatgctaagcactttgggag

SEQ ID NO: 7120 - DNA, 32 bp, Homo sapiens
gaacccaggaggtggaggttgcagtgagcaga

SEQ ID NO: 7121 - DNA, 32 bp, Homo sapiens
gaacctgggaggcagatgttgtggtgagccga

SEQ ID NO: 7122 - DNA, 32 bp, Homo sapiens
gaaccagggaggtggaggttgcagtgagccaa

SEQ ID NO: 7123 - DNA, 32 bp, Homo sapiens
aaagcctccaaccttgaagtccagtgaagtct

SEQ ID NO: 7124 - DNA, 19 bp, Homo sapiens
caggatgggagctgctgaa

SEQ ID NO: 7125 - DNA, 32 bp, Homo sapiens
gagcccaggaagtggaggttgcagtgagcaga

SEQ ID NO: 7126 - DNA, 32 bp, Homo sapiens
tcccctactcttcaccccttgttttcacctat

SEQ ID NO: 7127 - DNA, 32 bp, Homo sapiens
cttacgaggagacttggtcactgtgaaggaga

SEQ ID NO: 7128 - DNA, 32 bp, Homo sapiens
tcccctaccctcttttcttgcctgaatagtac

SEQ ID NO: 7129 - DNA, 32 bp, Homo sapiens
aagggctaagacgactcttccacacacaggtc

SEQ ID NO: 7130 - DNA, 32 bp, Homo sapiens
acatcatatacttcctcagaagcaattgcaac

SEQ ID NO: 7131 - DNA, 32 bp, Homo sapiens
gacttgctgtgtgcccttaaaccagccactac

SEQ ID NO: 7132 - DNA, 32 bp, Homo sapiens
tggggagagaggcagaggcagctggagcgccg

SEQ ID NO: 7133 - DNA, 32 bp, Homo sapiens
gaacctcagcggcggaggttgcagtgagtcga

SEQ ID NO: 7134 - DNA, 23 bp, Homo sapiens
ctgtcgccaagccagagtgcagt

SEQ ID NO: 7135 - DNA, 32 bp, Homo sapiens
ttctgccacatctcgcccttctggacctgcac

SEQ ID NO: 7136 - DNA, 32 bp, Homo sapiens
tactctcatcttctcccccgctcccttccact

SEQ ID NO: 7137 - DNA, 32 bp, Homo sapiens
tttgggaaagagacaggaaagattcacttgaa

SEQ ID NO: 7138 - DNA, 32 bp, Homo sapiens
ctctgttgccccaggctggagtgcagtggcgt

SEQ ID NO: 7139 - DNA, 32 bp, Homo sapiens
tgctactgtcccttctcacaggcattcacaga

SEQ ID NO: 7140 - DNA, 32 bp, Homo sapiens
ttggcccagctgaaaacggaattctttgccgg

SEQ ID NO: 7141 - DNA, 32 bp, Homo sapiens
gaagggtgagaggcagtgctgtggaaggggcc

SEQ ID NO: 7142 - DNA, 32 bp, Homo sapiens
agggggtgcccaggtggtggctgcaaggtggc

SEQ ID NO: 7143 - DNA, 32 bp, Homo sapiens
gcactgtcacccaggctgctggagtacagtgg

SEQ ID NO: 7144 - DNA, 32 bp, Homo sapiens
agctcgctcctgtaatcccagcactttgggag

SEQ ID NO: 7145 - DNA, 32 bp, Homo sapiens
cagaatgctgcaacttctcttctctctggact

SEQ ID NO: 7146 - DNA, 32 bp, Homo sapiens
tgaagccattggagagctgtcttcctgtgtac

SEQ ID NO: 7147 - DNA, 32 bp, Homo sapiens
aggcaatgcccaggcgggcctgggcactgtat

SEQ ID NO: 7148 - DNA, 20 bp, Homo sapiens
gacaagggtctccactgtgg

SEQ ID NO: 7149 - DNA, 32 bp, Homo sapiens
gccaggtggagttttgctcttgtcgcccaggc

SEQ ID NO: 7150 - DNA, 32 bp, Homo sapiens
gcttgcttgatagacatctcttacagtgagac

SEQ ID NO: 7151 - DNA, 32 bp, Homo sapiens
ggcatgaaccccaggctggagtgcagtggctc

SEQ ID NO: 7152 - DNA, 32 bp, Homo sapiens
gtgaagtgcccagcgctggagtgcagcgtgcc

SEQ ID NO: 7153 - DNA, 32 bp, Homo sapiens
gctgcttcatgggctgatgtgaggattaaaca

SEQ ID NO: 7154 - DNA, 32 bp, Homo sapiens
acctgcaggacagttttcctggagccatttgg

SEQ ID NO: 7155 - DNA, 32 bp, Homo sapiens
aaagtacatccttggaatctttgtccacacag

SEQ ID NO: 7156 - DNA, 32 bp, Homo sapiens
aaagtacaaggccggccgggtgcagtggctca

SEQ ID NO: 7157 - DNA, 32 bp, Homo sapiens
ccaggctcaagcgatcctcccacctcagctcc

SEQ ID NO: 7158 - DNA, 28 bp, Homo sapiens
ctggctgcccatcctgcctcatcacacg

SEQ ID NO: 7159 - DNA, 28 bp, Homo sapiens
gtgcccaacttctaagcctcatcagcaa

SEQ ID NO: 7160 - DNA, 32 bp, Homo sapiens
gaccgctgcccaggtggggtttcctgcatgga

SEQ ID NO: 7161 - DNA, 32 bp, Homo sapiens
tgctgtcattggagcggtgggcactgttaaga

SEQ ID NO: 7162 - DNA, 32 bp, Homo sapiens
caaagagcaaggaaagagagaaaacaacaaag

SEQ ID NO: 7163 - DNA, 28 bp, Homo sapiens
agacccaggcctgctgcctgcatctgca

SEQ ID NO: 7164 - DNA, 32 bp, Homo sapiens
gcagcgtcgcgggctgattaggtttcacccaa

SEQ ID NO: 7165 - DNA, 32 bp, Homo sapiens
tctttccccaaaagtgatgatctcaagtcctt

SEQ ID NO: 7166 - DNA, 32 bp, Homo sapiens
aaaatctctgcagtcaatttttatctcctctg

SEQ ID NO: 7167 - DNA, 32 bp, Homo sapiens
gcaagctacctgcgacagcttgaacttttcct

SEQ ID NO: 7168 - DNA, 32 bp, Homo sapiens
gtcctcccaaagtgctgggattgaaggcgtga

SEQ ID NO: 7169 - DNA, 32 bp, Homo sapiens
ttaccctggacagcaggaaacctgtatattca

SEQ ID NO: 7170 - DNA, 32 bp, Homo sapiens
cgggggcggaggcagctgaggcgcttctttcc

SEQ ID NO: 7171 - DNA, 32 bp, Homo sapiens
gcaggtctccagctgaatctgtgcctacgaat

SEQ ID NO: 7172 - DNA, 32 bp, Homo sapiens
tgagataaaacagatcaaatggtttaggttaa

SEQ ID NO: 7173 - DNA, 32 bp, Homo sapiens
ccccagggttgctgaggaagagcttgatgatc

SEQ ID NO: 7174 - DNA, 32 bp, Homo sapiens
cgctgccagcaaggagcttgcagtcttgtagc

SEQ ID NO: 7175 - DNA, 32 bp, Homo sapiens
ttcgtcttcggtttttctcttccttcgctaac

SEQ ID NO: 7176 - DNA, 32 bp, Homo sapiens
tttaaaccattccacccggcagtattcagctt

SEQ ID NO: 7177 - DNA, 32 bp, Homo sapiens
aagacgaagttctggcaaatgtggaaaacctg

SEQ ID NO: 7178 - DNA, 32 bp, Homo sapiens
ggcaaggggaggcaggagggtggcctggacct

SEQ ID NO: 7179 - DNA, 32 bp, Homo sapiens
ttctatcacccaggctggagtggagtggtatg

SEQ ID NO: 7180 - DNA, 32 bp, Homo sapiens
ccaaattcaagcatttcatctcaagagttgta

SEQ ID NO: 7181 - DNA, 32 bp, Homo sapiens
ccctgcccaagtgcctaggggcagtagacagc

SEQ ID NO: 7182 - DNA, 32 bp, Homo sapiens
caaatccatacagtgaggaatcagagtgttta

SEQ ID NO: 7183 - DNA, 32 bp, Homo sapiens
ccaaggcagagtcagaggttccacaggaggag

SEQ ID NO: 7184 - DNA, 32 bp, Homo sapiens
tggcctggggtctcttctttgctggacacagc

SEQ ID NO: 7185 - DNA, 32 bp, Homo sapiens
ttccattctaaccttgagccacagtgtcactc

SEQ ID NO: 7186 - DNA, 32 bp, Homo sapiens
attcaggtgatctctgtggaggtagtcaggga

SEQ ID NO: 7187 - DNA, 23 bp, Homo sapiens
tggtgcgacctcggctcactgca

SEQ ID NO: 7188 - DNA, 23 bp, Homo sapiens
tggcacgatcttggcttactaca

SEQ ID NO: 7189 - DNA, 17 bp, Homo sapiens
gccattcgcacccagga

SEQ ID NO: 7190 - DNA, 32 bp, Homo sapiens
agaccgatttccactccatctgtttcttctcc

SEQ ID NO: 7191 - DNA, 32 bp, Homo sapiens
tctctgtcacctaggctggagtgcagtggcac

SEQ ID NO: 7192 - DNA, 32 bp, Homo sapiens
tcgagatggagtttcactcttgtcgctcaggc

SEQ ID NO: 7193 - DNA, 32 bp, Homo sapiens
tcagtcccaagtgcccttttacagagaatgcc

SEQ ID NO: 7194 - DNA, 32 bp, Homo sapiens
ctctgttgctcaagctggagtggagtggcacg

SEQ ID NO: 7195 - DNA, 32 bp, Homo sapiens
ttgggttcaagcaaccctgcctcagctaacca

SEQ ID NO: 7196 - DNA, 32 bp, Homo sapiens
atgttgatgctgctgttcatggcactacaaag

SEQ ID NO: 7197 - DNA, 32 bp, Homo sapiens
ttaaggtctgcagccttaattctacctgcaaa

SEQ ID NO: 7198 - DNA, 32 bp, Homo sapiens
cgggtgatcgtagctcggaaatggcgggattt

SEQ ID NO: 7199 - DNA, 32 bp, Homo sapiens
ccaggatggtctcgatctcctgatctcgtgat

SEQ ID NO: 7200 - DNA, 29 bp, Homo sapiens
atgaaaaagcagggaatctcaaactttat

SEQ ID NO: 7201 - DNA, 32 bp, Homo sapiens
tcactgttgcccaggctggagtgcattgatgt

SEQ ID NO: 7202 - DNA, 32 bp, Homo sapiens
gtggctcatgcctgtatccagcactttgggag

SEQ ID NO: 7203 - DNA, 32 bp, Homo sapiens
gaggacctggagagctgggagaccatgatgag

SEQ ID NO: 7204 - DNA, 32 bp, Homo sapiens
ggactgaactgaacccctccccatgaacacaa

SEQ ID NO: 7205 - DNA, 32 bp, Homo sapiens
ttttgtcctagagtgagagtttggaaggtgtc

SEQ ID NO: 7206 - DNA, 32 bp, Homo sapiens
cccagcctcccaggctggatggcatggactgt

SEQ ID NO: 7207 - DNA, 32 bp, Homo sapiens
ctctgtcgctcaggctggagtgcagtggcgtg

SEQ ID NO: 7208 - DNA, 19 bp, Homo sapiens
ccactactccagcccagaa

SEQ ID NO: 7209 - DNA, 18 bp, Homo sapiens
ctggaatgtgtccattga

SEQ ID NO: 7210 - DNA, 32 bp, Homo sapiens
cacagtgatcgatgattcaggtgcagaggaag

SEQ ID NO: 7211 - DNA, 32 bp, Homo sapiens
ccttgctgatgagtaggatgtgatttggctct

SEQ ID NO: 7212 - DNA, 32 bp, Homo sapiens
gctctgtcacccgggctggagtgcagtggcgc

SEQ ID NO: 7213 - DNA, 32 bp, Homo sapiens
gagccacatccctcttacagctagtgaatgag

SEQ ID NO: 7214 - DNA, 32 bp, Homo sapiens
acctccgcctcctgggttcaagcgattcacct

SEQ ID NO: 7215 - DNA, 32 bp, Homo sapiens
ggcctcccaaagtgctgggattaaaggcgtga

SEQ ID NO: 7216 - DNA, 32 bp, Homo sapiens
agcctcctgagtagctgggattataggtgcga

SEQ ID NO: 7217 - DNA, 32 bp, Homo sapiens
agccacctgactagctgggattgcagcctgca

SEQ ID NO: 7218 - DNA, 32 bp, Homo sapiens
gagcccaggagttcagggctgcagtgaggtac

SEQ ID NO: 7219 - DNA, 32 bp, Homo sapiens
gtttgtcacccaggctggagtgctgtggtgtg

SEQ ID NO: 7220 - DNA, 32 bp, Homo sapiens
ctctgttgccaaggctggaatgcagtggcgag

SEQ ID NO: 7221 - DNA, 21 bp, Homo sapiens
cgcagccccccggccctgaga

SEQ ID NO: 7222 - DNA, 31 bp, Homo sapiens
gggacacacagccaggcaaggagggagctca

SEQ ID NO: 7223 - DNA, 32 bp, Homo sapiens
gatccggggaggtggaagttgcagtgggccaa

SEQ ID NO: 7224 - DNA, 32 bp, Homo sapiens
agttgggtccttgcctggattttgacacagca

SEQ ID NO: 7225 - DNA, 32 bp, Homo sapiens
tatttggtactttcacttactacacatcattt

SEQ ID NO: 7226 - DNA, 22 bp, Homo sapiens
gcacaccgttgagcacagcagc

SEQ ID NO: 7227 - DNA, 32 bp, Homo sapiens
aaataggtacggttttaaaatattttatatag

SEQ ID NO: 7228 - DNA, 32 bp, Homo sapiens
tttaagggccaggaaaggaagcattcagggaa

SEQ ID NO: 7229 - DNA, 20 bp, Homo sapiens
tgggccggatgagttgtgct

SEQ ID NO: 7230 - DNA, 32 bp, Homo sapiens
ctgggttcaagcaattctcccacctcagctgg

SEQ ID NO: 7231 - DNA, 32 bp, Homo sapiens
cctccctctggccccttctcccatggggacat

SEQ ID NO: 7232 - DNA, 32 bp, Homo sapiens
ttgggctctcagcagcctcttctgccagcacc

SEQ ID NO: 7233 - DNA, 32 bp, Homo sapiens
attgctgtagcagattctgttctgcctgctgc

SEQ ID NO: 7234 - DNA, 32 bp, Homo sapiens
ctgggttcaagtgaccctcccacctcagcctc

SEQ ID NO: 7235 - DNA, 32 bp, Homo sapiens
acttgagcctccatttctggcttctagtctgg

SEQ ID NO: 7236 - DNA, 32 bp, Homo sapiens
ataaaattgcccagtcttcagcggagcagttt

SEQ ID NO: 7237 - DNA, 32 bp, Homo sapiens
cctggtcatccctcagtcactcatatcagagt

SEQ ID NO: 7238 - DNA, 32 bp, Homo sapiens
cactgtggcccaggctggactccagcacagtg

SEQ ID NO: 7239 - DNA, 32 bp, Homo sapiens
ctgggttcaagcaattctcctgcctcaggctc

SEQ ID NO: 7240 - DNA, 32 bp, Homo sapiens
actcattgcctgtaatcccagcactttgggag

SEQ ID NO: 7241 - DNA, 32 bp, Homo sapiens
gagcccgtgaagtcgaggctgcagtgagccca

SEQ ID NO: 7242 - DNA, 32 bp, Homo sapiens
gaagtactacctgacttgagtcaatgcaccca

SEQ ID NO: 7243 - DNA, 32 bp, Homo sapiens
ccctgtgttgttacaggctgtgcagtgcaaca

SEQ ID NO: 7244 - DNA, 20 bp, Homo sapiens
ggaggaatgagaggtgggga

SEQ ID NO: 7245 - DNA, 32 bp, Homo sapiens
cagagttcttccttccccatctgggccttcat

SEQ ID NO: 7246 - DNA, 32 bp, Homo sapiens
cctgaatatcttctctgctcacttccaccatc

SEQ ID NO: 7247 - DNA, 23 bp, Homo sapiens
agagaggcggccgtcctgtcaac

SEQ ID NO: 7248 - DNA, 32 bp, Homo sapiens
cattgctgctgctacctgctttccagagcctt

SEQ ID NO: 7249 - DNA, 32 bp, Homo sapiens
tcctctctgctccaataccaccaccttgtcca

SEQ ID NO: 7250 - DNA, 32 bp, Homo sapiens
taaaactgccaagggagctctaacttgaagcc

SEQ ID NO: 7251 - DNA, 32 bp, Homo sapiens
gagcccaggaggttgaggctgcagtgagcaga

SEQ ID NO: 7252 - DNA, 32 bp, Homo sapiens
gtttgtcacccaggctggagtgcagtggcatg

SEQ ID NO: 7253 - DNA, 32 bp, Homo sapiens
tctgtctcctggaatgctcccacctcaagtgg

SEQ ID NO: 7254 - DNA, 32 bp, Homo sapiens
catgtgctgtaagtccctaggtgcaagctttt

SEQ ID NO: 7255 - DNA, 32 bp, Homo sapiens
ttgctcccaagaggaggagagggaggctgcag

SEQ ID NO: 7256 - DNA, 28 bp, Homo sapiens
ccagctggtggtgctgccctatcagatg

SEQ ID NO: 7257 - DNA, 23 bp, Homo sapiens
agagttggggacccctgttggcc

SEQ ID NO: 7258 - DNA, 20 bp, Homo sapiens
gcaagctcacattgctctcc

SEQ ID NO: 7259 - DNA, 24 bp, Homo sapiens
ctgtcgcccaagctggagtacagt

SEQ ID NO: 7260 - DNA, 32 bp, Homo sapiens
agcacataggctcaggcttctgtaggcttcct

SEQ ID NO: 7261 - DNA, 32 bp, Homo sapiens
ctcctgttgtgcaggctggagtgcagtggcac

SEQ ID NO: 7262 - DNA, 32 bp, Homo sapiens
ctggcgggttgcttcagccagtgcagtgagaa

SEQ ID NO: 7263 - DNA, 32 bp, Homo sapiens
tgtgtctgagcattctgctcccatggacatcc

SEQ ID NO: 7264 - DNA, 32 bp, Homo sapiens
tccctgtgctccacctgcctccgcagaaggaa

SEQ ID NO: 7265 - DNA, 32 bp, Homo sapiens
ctcttacgcccaggctggaatgaagtggcatg

SEQ ID NO: 7266 - DNA, 32 bp, Homo sapiens
gaggctgcagtgagctgggattacaccattgc

SEQ ID NO: 7267 - DNA, 32 bp, Homo sapiens
ctccaagaacatcagtgtgaggctggaattgt

SEQ ID NO: 7268 - DNA, 32 bp, Homo sapiens
gtgggaagaggggttaaggtgcagtgatgatg

SEQ ID NO: 7269 - DNA, 32 bp, Homo sapiens
aagcgctgcccaggtcctggggtggtggcagc

SEQ ID NO: 7270 - DNA, 32 bp, Homo sapiens
ctctgtcacccaggctggagtgaggtggtaca

SEQ ID NO: 7271 - DNA, 18 bp, Homo sapiens
ctccttcctgcccaggta

SEQ ID NO: 7272 - DNA, 25 bp, Homo sapiens
tcatgcctgtaaatcccagcacttt

SEQ ID NO: 7273 - DNA, 22 bp, Homo sapiens
tcacgcctgtaatcccggcact

SEQ ID NO: 7274 - DNA, 32 bp, Homo sapiens
gctctgtcacccgggctggagtgcagtggtgc

SEQ ID NO: 7275 - DNA, 32 bp, Homo sapiens
actctgttgcccaggctggagtgcagtgatgt

SEQ ID NO: 7276 - DNA, 32 bp, Homo sapiens
tttagatgtagttttgctcttgttgcccaggc

SEQ ID NO: 7277 - DNA, 32 bp, Homo sapiens
ctattgggatggaatggatgtattttgcatgt

SEQ ID NO: 7278 - DNA, 32 bp, Homo sapiens
actctgtcgcccaggctggagtgcagtgatgc

SEQ ID NO: 7279 - DNA, 32 bp, Homo sapiens
cctctctggcccaagctggagtgcagtggcac

SEQ ID NO: 7280 - DNA, 32 bp, Homo sapiens
ggggcttcccatgggagctgatggcttcgtgc

SEQ ID NO: 7281 - DNA, 32 bp, Homo sapiens
gaggcctggaccacctggggctccctgaggat

SEQ ID NO: 7282 - DNA, 21 bp, Homo sapiens
tgttgagatgcagattcctca

SEQ ID NO: 7283 - DNA, 32 bp, Homo sapiens
ccgggttcaagcaattccctgcctcagcctca

SEQ ID NO: 7284 - DNA, 32 bp, Homo sapiens
acacaaccaagcaatcctcgctttacagatga

SEQ ID NO: 7285 - DNA, 32 bp, Homo sapiens
tgtttttctagagtgaattatagtattgacgt

SEQ ID NO: 7286 - DNA, 32 bp, Homo sapiens
atactcgggaggctaaggcaggagaatcgctt

SEQ ID NO: 7287 - DNA, 32 bp, Homo sapiens
agctgcgggaggccgagtgggtggccgcgctc

SEQ ID NO: 7288 - DNA, 32 bp, Homo sapiens
gtcttcaagttttcactccagctacacagatg

SEQ ID NO: 7289 - DNA, 22 bp, Homo sapiens
ctcctttgagaggcgctccttg

SEQ ID NO: 7290 - DNA, 32 bp, Homo sapiens
agcaggaggagcggagaaaggagagggcgggg

SEQ ID NO: 7291 - DNA, 32 bp, Homo sapiens
cgggtgatgctagatggatgtgtacctggtgg

SEQ ID NO: 7292 - DNA, 32 bp, Homo sapiens
actctgtagcccagtctggagtgcagtggtac

SEQ ID NO: 7293 - DNA, 32 bp, Homo sapiens
ccagcctgcctgacctggattctgagaactgg

SEQ ID NO: 7294 - DNA, 32 bp, Homo sapiens
ctttccagcatgccctggggtgcagtggtcag

SEQ ID NO: 7295 - DNA, 32 bp, Homo sapiens
agcgtcctgagtagctggggattacaggcgcc

SEQ ID NO: 7296 - DNA, 32 bp, Homo sapiens
gcctccgcttccggggttcaagcgattctcct

SEQ ID NO: 7297 - DNA, 32 bp, Homo sapiens
tacaagaagaagaaagaaagaaatcccacaga

SEQ ID NO: 7298 - DNA, 30 bp, Homo sapiens
aaaagatggaactgagaaagaaaaggatat

SEQ ID NO: 7299 - DNA, 32 bp, Homo sapiens
ggaccccgcccaggcagggagctgctgtgagt

SEQ ID NO: 7300 - DNA, 32 bp, Homo sapiens
gaagagtctgcagcatttgttctcctggctcc

SEQ ID NO: 7301 - DNA, 32 bp, Homo sapiens
ctgggctcagacggctggcttctgcctacccg

SEQ ID NO: 7302 - DNA, 23 bp, Homo sapiens
tcagaaggtttagctgggcccag

SEQ ID NO: 7303 - DNA, 32 bp, Homo sapiens
gccagggagggaggagaaagccgaagcgaaag

SEQ ID NO: 7304 - DNA, 32 bp, Homo sapiens
agaaaattctgttctgattatatcaaggcaaa

SEQ ID NO: 7305 - DNA, 32 bp, Homo sapiens
ggtgctgtgctgctccacaaggcaaaacaaga

SEQ ID NO: 7306 - DNA, 32 bp, Homo sapiens
ctctgttgcctgggctggagtgcagtgccacg

SEQ ID NO: 7307 - DNA, 32 bp, Homo sapiens
ccgggtcaaggcccggtcgagtgcagtaccat

SEQ ID NO: 7308 - DNA, 32 bp, Homo sapiens
cagccgctgcccaggggagtggctgtggggag

SEQ ID NO: 7309 - DNA, 32 bp, Homo sapiens
acattagagaattggtcctggaagggaaagaa

SEQ ID NO: 7310 - DNA, 32 bp, Homo sapiens
acctccacctcccaggttcaagggattctccc

SEQ ID NO: 7311 - DNA, 32 bp, Homo sapiens
tcttgttgcctaggctggagtgcaatggtgcg

SEQ ID NO: 7312 - DNA, 32 bp, Homo sapiens
aagtgtagtctacaaacctcctataccagaat

SEQ ID NO: 7313 - DNA, 32 bp, Homo sapiens
aacctcctgagtagctgggattacaggagtgt

SEQ ID NO: 7314 - DNA, 32 bp, Homo sapiens
gagcccgggaggcggagcttgcggtgggccgg

SEQ ID NO: 7315 - DNA, 32 bp, Homo sapiens
gaacccaggaggtggaggttgcagtgaactga

SEQ ID NO: 7316 - DNA, 32 bp, Homo sapiens
catggagggaggcagaagagccagggtggtta

SEQ ID NO: 7317 - DNA, 32 bp, Homo sapiens
gaaccccagaggcagaggttgcggtgagccga

SEQ ID NO: 7318 - DNA, 32 bp, Homo sapiens
gaacccaggagatggaggttgcagtgagctga

SEQ ID NO: 7319 - DNA, 32 bp, Homo sapiens
gaacccgggagatgaaggttgcagtgagctga

SEQ ID NO: 7320 - DNA, 32 bp, Homo sapiens
gaacccgggaggcagactttgcagtgagctga

SEQ ID NO: 7321 - DNA, 32 bp, Homo sapiens
gaacccaggaagtagaggttgcagtgagccga

SEQ ID NO: 7322 - DNA, 32 bp, Homo sapiens
gaacccgagaggcggagcttgcagtgagccaa

SEQ ID NO: 7323 - DNA, 32 bp, Homo sapiens
aagagacagagtttcgcttgttgcccaggctg

SEQ ID NO: 7324 - DNA, 32 bp, Homo sapiens
ctagctgcacagttctctcttctccttgtcct

SEQ ID NO: 7325 - DNA, 32 bp, Homo sapiens
gtccgaggaggaggagaaggaggcctgcagaa

SEQ ID NO: 7326 - DNA, 32 bp, Homo sapiens
atccagagctaacaggctaaagtttcccattc

SEQ ID NO: 7327 - DNA, 32 bp, Homo sapiens
ctctttttgcccaggccggagtgcaatggcac

SEQ ID NO: 7328 - DNA, 32 bp, Homo sapiens
tggagccaggtagaggaaaagggtttgggcgt

SEQ ID NO: 7329 - DNA, 32 bp, Homo sapiens
ggctcatgcctgtgatcccagcactttgggtg

SEQ ID NO: 7330 - DNA, 32 bp, Homo sapiens
aatgactagactgtacattcccatgagccttc

SEQ ID NO: 7331 - DNA, 32 bp, Homo sapiens
aggccctcaagtgccctagggaagaagcaaga

SEQ ID NO: 7332 - DNA, 32 bp, Homo sapiens
gaaactgggaggtggaggttgcagtgagccaa

SEQ ID NO: 7333 - DNA, 32 bp, Homo sapiens
ctctgtcaccctggctggagtgcggtggcgat

SEQ ID NO: 7334 - DNA, 24 bp, Homo sapiens
tacattatcagccagcccagcctt

SEQ ID NO: 7335 - DNA, 32 bp, Homo sapiens
gtgagcttagaggaagaaagaaaacaattttt

SEQ ID NO: 7336 - DNA, 28 bp, Homo sapiens
aattccccaagtgtgaagcctcattcat

SEQ ID NO: 7337 - DNA, 32 bp, Homo sapiens
gggaggactctgctgcttcttaagctccagcg

SEQ ID NO: 7338 - DNA, 32 bp, Homo sapiens
cctgcaagagcctctcccagggcccagtcctc

SEQ ID NO: 7339 - DNA, 32 bp, Homo sapiens
ttctccctgagctcctggaaggagcagttacc

SEQ ID NO: 7340 - DNA, 23 bp, Homo sapiens
tggcgccatcttggctcactgca

SEQ ID NO: 7341 - DNA, 23 bp, Homo sapiens
tgacacagtcttggctcactgca

SEQ ID NO: 7342 - DNA, 24 bp, Homo sapiens
tggcactgatctcggctcactgca

SEQ ID NO: 7343 - DNA, 32 bp, Homo sapiens
gtactgtattaattgtccttgtttacttcaga

SEQ ID NO: 7344 - DNA, 32 bp, Homo sapiens
acgccagagccagcaggggctgtttcgggccg

SEQ ID NO: 7345 - DNA, 21 bp, Homo sapiens
gaagaaaacttaaaccctgtg

SEQ ID NO: 7346 - DNA, 32 bp, Homo sapiens
aaggaagagatttagattcactgtgatgaaaa

SEQ ID NO: 7347 - DNA, 32 bp, Homo sapiens
gctatattgcccaggctggtcttgaagtcctg

SEQ ID NO: 7348 - DNA, 32 bp, Homo sapiens
ctcttgttgcccagcctggagtgcaatagcgt

SEQ ID NO: 7349 - DNA, 32 bp, Homo sapiens
gagcccaggaggccaaggttgcagtgggccca

SEQ ID NO: 7350 - DNA, 18 bp, Homo sapiens
cttgctgtgtgacctgag

SEQ ID NO: 7351 - DNA, 32 bp, Homo sapiens
tggagaggcaggcagagggcagtggttctccc

SEQ ID NO: 7352 - DNA, 32 bp, Homo sapiens
gaaccagggaggcagaggttgcagtgagccca

SEQ ID NO: 7353 - DNA, 32 bp, Homo sapiens
atggagatggggtcttgctttgttgcccaggc

SEQ ID NO: 7354 - DNA, 32 bp, Homo sapiens
cctcctgtgctgctggtcactgtaacccacta

SEQ ID NO: 7355 - DNA, 32 bp, Homo sapiens
cttccctctggctctccacttctgcctccctc

SEQ ID NO: 7356 - DNA, 32 bp, Homo sapiens
accagtcccggcagtggccacaacagcacatc

SEQ ID NO: 7357 - DNA, 32 bp, Homo sapiens
tcccattccaatttgaatctttctatttcttt

SEQ ID NO: 7358 - DNA, 32 bp, Homo sapiens
atttcttttgcagcttcctataaagtttgtct

SEQ ID NO: 7359 - DNA, 32 bp, Homo sapiens
gaggaccttttggcttctctggagcctgcaag

SEQ ID NO: 7360 - DNA, 21 bp, Homo sapiens
cagaagtgcatggcccatcgt

SEQ ID NO: 7361 - DNA, 32 bp, Homo sapiens
cttagatgtgatgatggatgtacaactgcgtg

SEQ ID NO: 7362 - DNA, 32 bp, Homo sapiens
cttcggtcattagaggaatgagccgggagtga

SEQ ID NO: 7363 - DNA, 21 bp, Homo sapiens
atggatcagccaaggccgaga

SEQ ID NO: 7364 - DNA, 32 bp, Homo sapiens
agcctcccgagtagctgggattacaggtgtgc

SEQ ID NO: 7365 - DNA, 32 bp, Homo sapiens
agcttcccgagtagctgggattacaggcgtgc

SEQ ID NO: 7366 - DNA, 32 bp, Homo sapiens
agcctcctgagtagctgggattacaggtgtgt

SEQ ID NO: 7367 - DNA, 32 bp, Homo sapiens
tatatcaagcaataatctcccacccaaggctt

SEQ ID NO: 7368 - DNA, 32 bp, Homo sapiens
ctgggttcaagcagttctcgtgcctccctgag

SEQ ID NO: 7369 - DNA, 32 bp, Homo sapiens
aaggtatagcagcagttagaattctttgcaaa

SEQ ID NO: 7370 - DNA, 32 bp, Homo sapiens
ctctgtcgcccaggctggagtgcggtggcgcg

SEQ ID NO: 7371 - DNA, 32 bp, Homo sapiens
ctctgttacccaggctagagtgcaatggcgtg

SEQ ID NO: 7372 - DNA, 32 bp, Homo sapiens
tcaggttcaagcaattctcctgcctcagcctc

SEQ ID NO: 7373 - DNA, 32 bp, Homo sapiens
ctctgtcacccagactggagtgcagtggcacg

SEQ ID NO: 7374 - DNA, 32 bp, Homo sapiens
gtccaagctcaaagctggagtgcaatggcgca

SEQ ID NO: 7375 - DNA, 32 bp, Homo sapiens
ctctgttgcccaggcaggagtacagtggcatt

SEQ ID NO: 7376 - DNA, 32 bp, Homo sapiens
agcctacatcttcttattctatttaggaatcg

SEQ ID NO: 7377 - DNA, 32 bp, Homo sapiens
agtatcttccactgccccatctgttggccacc

SEQ ID NO: 7378 - DNA, 32 bp, Homo sapiens
ctctgtcacccaggctggagtgcggtggcgca

SEQ ID NO: 7379 - DNA, 32 bp, Homo sapiens
ccacagcagctttgctcagtgatacccacatg

SEQ ID NO: 7380 - DNA, 32 bp, Homo sapiens
agtttccccaaaattggacttctcagaacctt

SEQ ID NO: 7381 - DNA, 32 bp, Homo sapiens
cctactttcctctcctgctttctgcctgtgac

SEQ ID NO: 7382 - DNA, 32 bp, Homo sapiens
ctctgtcgcccaggctggagtgcagtggcgca

SEQ ID NO: 7383 - DNA, 32 bp, Homo sapiens
ggagctctctaaggagctaaggtccatgggaa

SEQ ID NO: 7384 - DNA, 23 bp, Homo sapiens
ctgtcgccaggctgaagtgcagt

SEQ ID NO: 7385 - DNA, 32 bp, Homo sapiens
ctctgtcacccaggctggagtgcagtggcgcg

SEQ ID NO: 7386 - DNA, 32 bp, Homo sapiens
ctctgtcgcgcagggtggagtgcggtggcacg

SEQ ID NO: 7387 - DNA, 32 bp, Homo sapiens
ctctgtcacccaggctggagtacagtggcacg

SEQ ID NO: 7388 - DNA, 32 bp, Homo sapiens
cactgcactccaggctgggtgacagagcgaga

SEQ ID NO: 7389 - DNA, 32 bp, Homo sapiens
tgcaaagctgttgccatgctgtggaagctctg

SEQ ID NO: 7390 - DNA, 32 bp, Homo sapiens
actcccgtggggaagcagcgtcactgtgccct

SEQ ID NO: 7391 - DNA, 32 bp, Homo sapiens
tcaacaccttccttaagtctttgctgtcataa

SEQ ID NO: 7392 - DNA, 32 bp, Homo sapiens
gagccttcatattttcttctttgctgccttct

SEQ ID NO: 7393 - DNA, 32 bp, Homo sapiens
caccagtcccccagactgggtgaaggtacagc

SEQ ID NO: 7394 - DNA, 32 bp, Homo sapiens
ttgtgctatgtggagctcacagcctcacatgt

SEQ ID NO: 7395 - DNA, 32 bp, Homo sapiens
ctccagccctgcgtttccattctgccttctca

SEQ ID NO: 7396 - DNA, 32 bp, Homo sapiens
tctcccccaacaaaacccatacctatcaagct

SEQ ID NO: 7397 - DNA, 32 bp, Homo sapiens
gtctgacacctgggctggagtgcagtggtgca

SEQ ID NO: 7398 - DNA, 32 bp, Homo sapiens
ggatcacacctgcaatcccagcactttgggag

SEQ ID NO: 7399 - DNA, 32 bp, Homo sapiens
atcaaagaaccacagccgctgtgggaggatta

SEQ ID NO: 7400 - DNA, 32 bp, Homo sapiens
gcccagcggagtgcccttctgagcagcgggcg

SEQ ID NO: 7401 - DNA, 32 bp, Homo sapiens
gaacctgggaggcggaggttgcagtgagccac

SEQ ID NO: 7402 - DNA, 32 bp, Homo sapiens
gccgcctgattaaataatgtgctgctaaatat

SEQ ID NO: 7403 - DNA, 22 bp, Homo sapiens
tgggcaaagttaagacttgctt

SEQ ID NO: 7404 - DNA, 32 bp, Homo sapiens
tccaaccccaaaacaccactggccttctttca

SEQ ID NO: 7405 - DNA, 32 bp, Homo sapiens
gggtagaggccaggagaaaggaaagagttgta

SEQ ID NO: 7406 - DNA, 32 bp, Homo sapiens
gcaaataaaattattgaaaataattttaaagt

SEQ ID NO: 7407 - DNA, 23 bp, Homo sapiens
gggtcttctactccctccctgca

SEQ ID NO: 7408 - DNA, 23 bp, Homo sapiens
tcgcccaggctggagtacagtga

SEQ ID NO: 7409 - DNA, 32 bp, Homo sapiens
ccctcttaatgcctttgctagtgcagtgtatt

SEQ ID NO: 7410 - DNA, 32 bp, Homo sapiens
tatatactgaggctgtcatacccagattccca

SEQ ID NO: 7411 - DNA, 32 bp, Homo sapiens
tttgcggatactttgcttattcgtttaacgac

SEQ ID NO: 7412 - DNA, 32 bp, Homo sapiens
agcctctccagtagctgggattacaggtgtgt

SEQ ID NO: 7413 - DNA, 32 bp, Homo sapiens
aaatccaggaggcaaaggttgcagtgagccaa

SEQ ID NO: 7414 - DNA, 32 bp, Homo sapiens
ctggactcaagcaacctacccagcgtggcctc

SEQ ID NO: 7415 - DNA, 32 bp, Homo sapiens
ggtaagttttagtcaaaagaattctttcttga

SEQ ID NO: 7416 - DNA, 32 bp, Homo sapiens
ggaacggtgatcttcttgaatgatgtttcagt

SEQ ID NO: 7417 - DNA, 24 bp, Homo sapiens
tcacgcctctaatcgcagcacttt

SEQ ID NO: 7418 - DNA, 21 bp, Homo sapiens
atctgctcccctcaactctca

SEQ ID NO: 7419 - DNA, 23 bp, Homo sapiens
gacaggggaccaaggtcagggcc

SEQ ID NO: 7420 - DNA, 32 bp, Homo sapiens
atctctggggcccactctcttctgtcttccca

SEQ ID NO: 7421 - DNA, 32 bp, Homo sapiens
acaacacagctgccgtttcttctgcctgctta

SEQ ID NO: 7422 - DNA, 32 bp, Homo sapiens
gaaggatgcggagcccagcactgtgaagccta

SEQ ID NO: 7423 - DNA, 22 bp, Homo sapiens
tctcaataaccaggtcatcagg

SEQ ID NO: 7424 - DNA, 22 bp, Homo sapiens
tggcctgtctcggctcactgca

SEQ ID NO: 7425 - DNA, 32 bp, Homo sapiens
agcagaatgtgcttctctctggcagctggcct

SEQ ID NO: 7426 - DNA, 32 bp, Homo sapiens
actctgtaacccaggctggagtgcagtggcct

SEQ ID NO: 7427 - DNA, 32 bp, Homo sapiens
ctgtttataatctgaagatatatttcactttt

SEQ ID NO: 7428 - DNA, 32 bp, Homo sapiens
acctccgcctccggggttcaagcgattctcct

SEQ ID NO: 7429 - DNA, 32 bp, Homo sapiens
gctctgtcgcctggctggagtgcagtggtgtg

SEQ ID NO: 7430 - DNA, 32 bp, Homo sapiens
agcttcctgagtagctgggacaacaggtgtga

SEQ ID NO: 7431 - DNA, 32 bp, Homo sapiens
tcttaaaagcatcagtctgtaactagaacaaa

SEQ ID NO: 7432 - DNA, 17 bp, Homo sapiens
gcccctgccctggcagg

SEQ ID NO: 7433 - DNA, 32 bp, Homo sapiens
gggtgtggaagaggaaagtgtgaagcaaggga

SEQ ID NO: 7434 - DNA, 32 bp, Homo sapiens
ctgctggggaggcagagaccctgcaatggcca

SEQ ID NO: 7435 - DNA, 32 bp, Homo sapiens
atatcccccaaaatgaagttaccttccaagtt

SEQ ID NO: 7436 - DNA, 32 bp, Homo sapiens
gtacgatccaaaacattgtacccagcttttta

SEQ ID NO: 7437 - DNA, 32 bp, Homo sapiens
ctgtgacagcttctccctggagcctctggcca

SEQ ID NO: 7438 - DNA, 32 bp, Homo sapiens
ttgagatggagttttgctcttgtcggccaggc

SEQ ID NO: 7439 - DNA, 32 bp, Homo sapiens
acctgtcctgtttgagggaacagggtcgaccc

SEQ ID NO: 7440 - DNA, 24 bp, Homo sapiens
ctggagggaccagagtctgagctg

SEQ ID NO: 7441 - DNA, 32 bp, Homo sapiens
tgtttgtcttccattccattgttttgaaactc

SEQ ID NO: 7442 - DNA, 32 bp, Homo sapiens
tcggccggaagaagataaagaaaacaacacgc

SEQ ID NO: 7443 - DNA, 24 bp, Homo sapiens
ggactcagaattgtagggataata

SEQ ID NO: 7444 - DNA, 32 bp, Homo sapiens
ttgggcctctcaaaaggaaatgcttttgttta

SEQ ID NO: 7445 - DNA, 32 bp, Homo sapiens
agcttcctgaagtgctgggattacaggcatga

SEQ ID NO: 7446 - DNA, 32 bp, Homo sapiens
tctttgctaccaggctgaagtctgtcatgaaa

SEQ ID NO: 7447 - DNA, 23 bp, Homo sapiens
gcttggaagacgctgccttcccc

SEQ ID NO: 7448 - DNA, 32 bp, Homo sapiens
ccgtgagcccgaggctggaagtggtgtctgcc

SEQ ID NO: 7449 - DNA, 32 bp, Homo sapiens
gaacatggtagacagaggttgcagtgagccaa

SEQ ID NO: 7450 - DNA, 32 bp, Homo sapiens
gagcctcggaggcggaggttgcagtgagctga

SEQ ID NO: 7451 - DNA, 32 bp, Homo sapiens
gggctccaccagaccctgatgctgctacgtat

SEQ ID NO: 7452 - DNA, 32 bp, Homo sapiens
gtctcaaactcctggcctcaagcaattctccc

SEQ ID NO: 7453 - DNA, 28 bp, Homo sapiens
cctcccacaagtcgcgcctcatcgagca

SEQ ID NO: 7454 - DNA, 28 bp, Homo sapiens
caaactccaagacctgcctcacctcacc

SEQ ID NO: 7455 - DNA, 32 bp, Homo sapiens
tctcgggttcaagtgactcttctgcctcagcc

SEQ ID NO: 7456 - DNA, 24 bp, Homo sapiens
gaacatgcccacaacttgtcaccc

SEQ ID NO: 7457 - DNA, 21 bp, Homo sapiens
aggcccttcatcttcatggcc

SEQ ID NO: 7458 - DNA, 32 bp, Homo sapiens
gccattctgaggaacatctccaaggaacggga

SEQ ID NO: 7459 - DNA, 32 bp, Homo sapiens
cttgtctttaaaacatgatagtcctttcagta

SEQ ID NO: 7460 - DNA, 32 bp, Homo sapiens
gctgaccccaaaacccttccacactttattag

SEQ ID NO: 7461 - DNA, 32 bp, Homo sapiens
gaggctccagttctcatctgctcaggtgtccc

SEQ ID NO: 7462 - DNA, 32 bp, Homo sapiens
aggcatcatccctacctctgcaggctcaggtg

SEQ ID NO: 7463 - DNA, 21 bp, Homo sapiens
ctgtggctctcccgttgcaga

SEQ ID NO: 7464 - DNA, 32 bp, Homo sapiens
atcattttcctacggcgttagcactttaagca

SEQ ID NO: 7465 - DNA, 32 bp, Homo sapiens
cgtgggagaagatgacccgtggaacacttgcc

SEQ ID NO: 7466 - DNA, 32 bp, Homo sapiens
ccaggaagcaagcggaggttgcagtgagttga

SEQ ID NO: 7467 - DNA, 32 bp, Homo sapiens
ctctgttgtccaggctggagtgcagcgatatg

SEQ ID NO: 7468 - DNA, 32 bp, Homo sapiens
ggctcactcctgtaatcccagcactttgggag

SEQ ID NO: 7469 - DNA, 24 bp, Homo sapiens
tcacagctgtaatcccagcacttt

SEQ ID NO: 7470 - DNA, 23 bp, Homo sapiens
tcacgcctgtaatccccacactt

SEQ ID NO: 7471 - DNA, 28 bp, Homo sapiens
taggtagtcaaggcagcctcatctcccc

SEQ ID NO: 7472 - DNA, 32 bp, Homo sapiens
gctctgtagcccaggccagagtgcagtggcgc

SEQ ID NO: 7473 - DNA, 32 bp, Homo sapiens
gcagcccggttcctaacagaccacagacccca

SEQ ID NO: 7474 - DNA, 24 bp, Homo sapiens
tcacgcctgtaatccctgcacttt

SEQ ID NO: 7475 - DNA, 21 bp, Homo sapiens
agggccacttagagagcagta

SEQ ID NO: 7476 - DNA, 32 bp, Homo sapiens
aagatgtgcccaggaggtggcggtggcgcaca

SEQ ID NO: 7477 - DNA, 32 bp, Homo sapiens
caccctgggaattggcagcatgtggaggaact

SEQ ID NO: 7478 - DNA, 32 bp, Homo sapiens
tcagccctgtgtctgtcacaggctgggtcaaa

SEQ ID NO: 7479 - DNA, 32 bp, Homo sapiens
cactggcatcttcttttaacttgggccatctg

SEQ ID NO: 7480 - DNA, 32 bp, Homo sapiens
tgatggccagcagtgaggaatctgtgtgttct

SEQ ID NO: 7481 - DNA, 32 bp, Homo sapiens
aattcacttgttctgtcagtaatccataagac

SEQ ID NO: 7482 - DNA, 32 bp, Homo sapiens
tgggcgccagttctccacaaccacagggcaga

SEQ ID NO: 7483 - DNA, 32 bp, Homo sapiens
gggttcttcgggtgtgatcatatatcataaag

SEQ ID NO: 7484 - DNA, 32 bp, Homo sapiens
ccttgttgcccaggctggagtgcaatggcgcg

SEQ ID NO: 7485 - DNA, 32 bp, Homo sapiens
atggagcctgccttggggagtgcatgtgttgg

SEQ ID NO: 7486 - DNA, 32 bp, Homo sapiens
gcagctcttgcccagagctgtgcagtgcagtg

SEQ ID NO: 7487 - DNA, 32 bp, Homo sapiens
gcagaggcttaaggagctacactgggggaagg

SEQ ID NO: 7488 - DNA, 32 bp, Homo sapiens
caaatacatccactccccatgccactgacatc

SEQ ID NO: 7489 - DNA, 32 bp, Homo sapiens
ttatatgattcctgccatttgctgctaaatct

SEQ ID NO: 7490 - DNA, 32 bp, Homo sapiens
actctgtcacctaggctacagtgcagtggtgt

SEQ ID NO: 7491 - DNA, 32 bp, Homo sapiens
ctaagcaccatttaaagccactggaaatttgt

SEQ ID NO: 7492 - DNA, 20 bp, Homo sapiens
cagggaagccccacatgtcc

SEQ ID NO: 7493 - DNA, 32 bp, Homo sapiens
ctggggaagtgggagggatgtgatgctggaga

SEQ ID NO: 7494 - DNA, 32 bp, Homo sapiens
aatggaaatgttcttggagctacttcctcaaa

SEQ ID NO: 7495 - DNA, 32 bp, Homo sapiens
accctgttgcccaggctggagtgcaatggcgc

SEQ ID NO: 7496 - DNA, 32 bp, Homo sapiens
tgcgctgtaattccctgctccctggagactgg

SEQ ID NO: 7497 - DNA, 32 bp, Homo sapiens
gtattctgtaccatagcgctgctcttatgcca

SEQ ID NO: 7498 - DNA, 32 bp, Homo sapiens
acctccgccttcctggttcaagtgattctcct

SEQ ID NO: 7499 - DNA, 32 bp, Homo sapiens
ttacctgctgggacctgctcccagagaccttc

SEQ ID NO: 7500 - DNA, 32 bp, Homo sapiens
atttcctacctaagcatctcccgagaaaaata

SEQ ID NO: 7501 - DNA, 32 bp, Homo sapiens
gaaacctctgcagctcattctgccactgcaaa

SEQ ID NO: 7502 - DNA, 32 bp, Homo sapiens
cctgggggaggggcctggtcactgtgaacaca

SEQ ID NO: 7503 - DNA, 32 bp, Homo sapiens
ctggccatgctgctgcccagctctacccctcc

SEQ ID NO: 7504 - DNA, 32 bp, Homo sapiens
aaaggcaggtgcttttggcagagaccataaga

SEQ ID NO: 7505 - DNA, 32 bp, Homo sapiens
tacccatttatcctatttttagcaataattcg

SEQ ID NO: 7506 - DNA, 32 bp, Homo sapiens
tggaaaaatcgagcctctcccaccctcagtcg

SEQ ID NO: 7507 - DNA, 32 bp, Homo sapiens
cctaggctaagcaatcctcccaccttagcctc

SEQ ID NO: 7508 - DNA, 28 bp, Homo sapiens
tccaaggccaatgctgcctgctctgttt

SEQ ID NO: 7509 - DNA, 32 bp, Homo sapiens
ctcctattcccacgccttaacacagctctata

SEQ ID NO: 7510 - DNA, 32 bp, Homo sapiens
tagtatacaaaccattatgatttatgctactt

SEQ ID NO: 7511 - DNA, 32 bp, Homo sapiens
tctctgtccccaaggctggagtgcagtggtgc

SEQ ID NO: 7512 - DNA, 32 bp, Homo sapiens
ccagcccattggagaaaagttactgttcagtc

SEQ ID NO: 7513 - DNA, 32 bp, Homo sapiens
tcctcaacttcctgggctcaagtgatccttcc

SEQ ID NO: 7514 - DNA, 32 bp, Homo sapiens
tcttcccacttgctgaccctttgctacctatg

SEQ ID NO: 7515 - DNA, 32 bp, Homo sapiens
ccctcaagcatcctgatttgttcgttctctct

SEQ ID NO: 7516 - DNA, 32 bp, Homo sapiens
tcaaacctgagtatcagtacatgcctagacct

SEQ ID NO: 7517 - DNA, 32 bp, Homo sapiens
tgttattggatttcctggaagatgtggtagct

SEQ ID NO: 7518 - DNA, 24 bp, Homo sapiens
tcacgcctgtcatcccagcacttt

SEQ ID NO: 7519 - DNA, 24 bp, Homo sapiens
tcacgcctgtaatcccagaacttt

SEQ ID NO: 7520 - DNA, 32 bp, Homo sapiens
ttcggtctagttctgtcagttgctgagagagg

SEQ ID NO: 7521 - DNA, 17 bp, Homo sapiens
cagggagcccccagccc

SEQ ID NO: 7522 - DNA, 32 bp, Homo sapiens
ctctcctttctctcttctcttccttcctctcc

SEQ ID NO: 7523 - DNA, 32 bp, Homo sapiens
cactttgtttcaggctggtctgtgccccgtga

SEQ ID NO: 7524 - DNA, 32 bp, Homo sapiens
tgtcgcccacccaggctggagtacagtggcac

SEQ ID NO: 7525 - DNA, 32 bp, Homo sapiens
atcaccttaccatcagagcagtgcagtgctct

SEQ ID NO: 7526 - DNA, 32 bp, Homo sapiens
gctttgaacttgatgtggcattacatgttctt

SEQ ID NO: 7527 - DNA, 32 bp, Homo sapiens
acttccacttcccaggttcaagtgattctcct

SEQ ID NO: 7528 - DNA, 24 bp, Homo sapiens
tcacgcctgtaatctcagcacttt

SEQ ID NO: 7529 - DNA, 32 bp, Homo sapiens
caccatgccggtgtgaggagcatctgttcttc

SEQ ID NO: 7530 - DNA, 32 bp, Homo sapiens
ctgaagaagtgccttttgagtgcaatgaatgt

SEQ ID NO: 7531 - DNA, 32 bp, Homo sapiens
cttccccatcttctcctctattctggtctccc

SEQ ID NO: 7532 - DNA, 24 bp, Homo sapiens
tcacgcttgtaatcccagcacttt

SEQ ID NO: 7533 - DNA, 20 bp, Homo sapiens
gcctgtaatcccagcacttt

SEQ ID NO: 7534 - DNA, 32 bp, Homo sapiens
ttgagatggagttttgctcttgttgcccagac

SEQ ID NO: 7535 - DNA, 32 bp, Homo sapiens
ctgctgaagccatctccttgccgacaaacaca

SEQ ID NO: 7536 - DNA, 32 bp, Homo sapiens
gctcagggcactgagagatcccagaaggtaac

SEQ ID NO: 7537 - DNA, 32 bp, Homo sapiens
atctgtcacccaggctggagtgcagtagtgca

SEQ ID NO: 7538 - DNA, 32 bp, Homo sapiens
cccccagcctccagaccctctaatgccctcag

SEQ ID NO: 7539 - DNA, 32 bp, Homo sapiens
ggggttagggcaaaacattcaaacttcatcag

SEQ ID NO: 7540 - DNA, 32 bp, Homo sapiens
agaagaagaggaagagaggcctgagcgagcat

SEQ ID NO: 7541 - DNA, 32 bp, Homo sapiens
agcccctgtaccacccctgctgttgcctgggc

SEQ ID NO: 7542 - DNA, 32 bp, Homo sapiens
gcctgtgtctcctgggttcaagcgattctcct

SEQ ID NO: 7543 - DNA, 31 bp, Homo sapiens
acgtcgacttcatcagccaggagggagagct

SEQ ID NO: 7544 - DNA, 31 bp, Homo sapiens
actgccggcagcaggcagaggagggaggggg

SEQ ID NO: 7545 - DNA, 31 bp, Homo sapiens
acaacacacatctgggacaggagggaatgcg

SEQ ID NO: 7546 - DNA, 32 bp, Homo sapiens
aacaccaccaaaacagatacccatgttgaggg

SEQ ID NO: 7547 - DNA, 32 bp, Homo sapiens
ccttttggtggcctctccaggtgcaaaacttc

SEQ ID NO: 7548 - DNA, 32 bp, Homo sapiens
cagtgggttatatgtctcagcccaagtccttg

SEQ ID NO: 7549 - DNA, 32 bp, Homo sapiens
gcttataacatcctgactatgcttacaaatat

SEQ ID NO: 7550 - DNA, 32 bp, Homo sapiens
ctgggctcaagtgatcctcccacctcagcctc

SEQ ID NO: 7551 - DNA, 32 bp, Homo sapiens
ctgggttcaagtgatcctcccacctcagcttc

SEQ ID NO: 7552 - DNA, 32 bp, Homo sapiens
tcttgttgcccaggctggagtacaatggcgtg

SEQ ID NO: 7553 - DNA, 32 bp, Homo sapiens
tcttgttgcccaggctggagtgcaatggcatg

SEQ ID NO: 7554 - DNA, 32 bp, Homo sapiens
tcttgttgcccaggttagagtgcagtggcacg

SEQ ID NO: 7555 - DNA, 21 bp, Homo sapiens
ggcgccagctcgctccaggga

SEQ ID NO: 7556 - DNA, 32 bp, Homo sapiens
tcaggcccaagtgccatccatagtccatctcc

SEQ ID NO: 7557 - DNA, 32 bp, Homo sapiens
ctacttgggaggcagaggtgggaagatggttt

SEQ ID NO: 7558 - DNA, 32 bp, Homo sapiens
cagcccccagttctgctcaaggacagagaaaa

SEQ ID NO: 7559 - DNA, 32 bp, Homo sapiens
ctctgacgcacaggctggagtgcagtggctcc

SEQ ID NO: 7560 - DNA, 32 bp, Homo sapiens
taactcttttgcccttctcttctgccagtgaa

SEQ ID NO: 7561 - DNA, 28 bp, Homo sapiens
ccgggagaagatgctgcctcgttgttat

SEQ ID NO: 7562 - DNA, 32 bp, Homo sapiens
aatatcccaagtgcctggctttgatagttaaa

SEQ ID NO: 7563 - DNA, 32 bp, Homo sapiens
gaacctgggagatggagattgcagtgagcaga

SEQ ID NO: 7564 - DNA, 32 bp, Homo sapiens
cccggtacctctctccccactggccaggactc

SEQ ID NO: 7565 - DNA, 31 bp, Homo sapiens
ggttcccagaacagacctaggaggcggcctc

SEQ ID NO: 7566 - DNA, 24 bp, Homo sapiens
tcatgcctgtaatcccaatacttt

SEQ ID NO: 7567 - DNA, 32 bp, Homo sapiens
ggcccttcacccagagccagtgtggtcagtat

SEQ ID NO: 7568 - DNA, 32 bp, Homo sapiens
cggcccctgctgctgctcgggcagctgcacca

SEQ ID NO: 7569 - DNA, 17 bp, Homo sapiens
gaacccataggcagtcc

SEQ ID NO: 7570 - DNA, 32 bp, Homo sapiens
gtggggctgcccaggcaaagtcagtgaacatg

SEQ ID NO: 7571 - DNA, 32 bp, Homo sapiens
ctcttattgcccaggctggagtgcaatggcac

SEQ ID NO: 7572 - DNA, 32 bp, Homo sapiens
aaattgccctgcaggctggagtgcagcggcat

SEQ ID NO: 7573 - DNA, 32 bp, Homo sapiens
ggcatacctttcaatttctctgatctctatgg

SEQ ID NO: 7574 - DNA, 32 bp, Homo sapiens
cttttgttgcccaggctggagtgtagtggcgc

SEQ ID NO: 7575 - DNA, 32 bp, Homo sapiens
ctcttgttgcccaagctggagtgcaatggcac

SEQ ID NO: 7576 - DNA, 32 bp, Homo sapiens
ggctcttgcctgtaatcccagcactttgggag

SEQ ID NO: 7577 - DNA, 32 bp, Homo sapiens
gaacccagtaggcggaagttgcagtgagctga

SEQ ID NO: 7578 - DNA, 32 bp, Homo sapiens
ctgagctcaagcaatcctcctgcctcagcctc

SEQ ID NO: 7579 - DNA, 32 bp, Homo sapiens
gcatctccaacatctctccccacctcatgatt

SEQ ID NO: 7580 - DNA, 32 bp, Homo sapiens
tggccccatcttctggcccttagctggtgcca

SEQ ID NO: 7581 - DNA, 20 bp, Homo sapiens
gcccctgccgcagcccggta

SEQ ID NO: 7582 - DNA, 32 bp, Homo sapiens
cttcccgggaggccctgggaggtgatcattga

SEQ ID NO: 7583 - DNA, 32 bp, Homo sapiens
tcattgttgcccaggaagagacggaggatgca

SEQ ID NO: 7584 - DNA, 32 bp, Homo sapiens
cctgtggtccccgagacacaggcacgggtccc

SEQ ID NO: 7585 - DNA, 32 bp, Homo sapiens
tgggcttgcctgcccttcaacagggtctattg

SEQ ID NO: 7586 - DNA, 32 bp, Homo sapiens
acctgcacctcctgggttcaagcaattctcca

SEQ ID NO: 7587 - DNA, 32 bp, Homo sapiens
tggggttcaagcgatcctcccacctcagcctc

SEQ ID NO: 7588 - DNA, 32 bp, Homo sapiens
ctgggctcaagcaattttcctgccttgggcct

SEQ ID NO: 7589 - DNA, 32 bp, Homo sapiens
cagggctcaagcagtcctcccacctcagcctc

SEQ ID NO: 7590 - DNA, 32 bp, Homo sapiens
tgagcctgggagcaagggttgcagtgagctga

SEQ ID NO: 7591 - DNA, 32 bp, Homo sapiens
gaaccagggagtcagaggtttcagtgagccaa

SEQ ID NO: 7592 - DNA, 32 bp, Homo sapiens
cctgtggggagagtgaggttgctggagccacg

SEQ ID NO: 7593 - DNA, 32 bp, Homo sapiens
tatactcctcaaggatgctgcatttggaccta

SEQ ID NO: 7594 - DNA, 32 bp, Homo sapiens
gataacccctttctcccctttggaccatctgc

SEQ ID NO: 7595 - DNA, 32 bp, Homo sapiens
ggaaggccaagtgctgcaagtggctgggagtg

SEQ ID NO: 7596 - DNA, 32 bp, Homo sapiens
tgacgctgcccaggaaaggagttctgagtgct

SEQ ID NO: 7597 - DNA, 32 bp, Homo sapiens
aaggaaaaggtttaagaaagaaaacaaaacca

SEQ ID NO: 7598 - DNA, 32 bp, Homo sapiens
atctttggtgacgggtcacaggcattggtagt

SEQ ID NO: 7599 - DNA, 32 bp, Homo sapiens
ccaagggaggcttggcggctgtggaggcgagt

SEQ ID NO: 7600 - DNA, 32 bp, Homo sapiens
atctgtccagaacctgctcccacctcaggccc

SEQ ID NO: 7601 - DNA, 32 bp, Homo sapiens
ccaggttcaagcaattctctgtctcagcctcc

SEQ ID NO: 7602 - DNA, 32 bp, Homo sapiens
cacccagaacagttggaagtgtggaaaggagg

SEQ ID NO: 7603 - DNA, 32 bp, Homo sapiens
ctttcatcctctcttacccttctgccttccac

SEQ ID NO: 7604 - DNA, 32 bp, Homo sapiens
ctggcatctcttctccctggccccagccatcc

SEQ ID NO: 7605 - DNA, 32 bp, Homo sapiens
ccggctgggaggcagccgtctgtgcagcgagc

SEQ ID NO: 7606 - DNA, 32 bp, Homo sapiens
tgtggtgtgctgctgtccacagataaaccagt

SEQ ID NO: 7607 - DNA, 22 bp, Homo sapiens
cccaaagcccgggagcttggca

SEQ ID NO: 7608 - DNA, 32 bp, Homo sapiens
ttggctagagcctcataaaagaccccaggttt

SEQ ID NO: 7609 - DNA, 32 bp, Homo sapiens
atctataaaatgagagaaaatatttgcaatcc

SEQ ID NO: 7610 - DNA, 32 bp, Homo sapiens
actttttatggtgctgattaatggtgatcaag

SEQ ID NO: 7611 - DNA, 32 bp, Homo sapiens
tgctgcccaaccatgggccactgtgaacagac

SEQ ID NO: 7612 - DNA, 32 bp, Homo sapiens
tcaagcaggttagagaaaatagagatgaatta

SEQ ID NO: 7613 - DNA, 32 bp, Homo sapiens
gctgtatttcccaggctggagtgcagaggcac

SEQ ID NO: 7614 - DNA, 32 bp, Homo sapiens
acatgcccagttcatgtcatctctcttaagaa

SEQ ID NO: 7615 - DNA, 32 bp, Homo sapiens
attaacacttaaggttgggtgctgctaattct

SEQ ID NO: 7616 - DNA, 32 bp, Homo sapiens
gcagcctcataagggctggagtgctgtggtgc

SEQ ID NO: 7617 - DNA, 32 bp, Homo sapiens
gagtgagaaccttggcggctgtggaggctgcc

SEQ ID NO: 7618 - DNA, 21 bp, Homo sapiens
gcgcgatcttggctcaccgca

SEQ ID NO: 7619 - DNA, 21 bp, Homo sapiens
gcacgatctcagctcactgca

SEQ ID NO: 7620 - DNA, 32 bp, Homo sapiens
gcccagcacagtgccctgcacacagtagtcgc

SEQ ID NO: 7621 - DNA, 32 bp, Homo sapiens
actctgtcgcccaggctggaatgcagtggcgt

SEQ ID NO: 7622 - DNA, 32 bp, Homo sapiens
gctcggggctgcaggctggagtgcagtgggac

SEQ ID NO: 7623 - DNA, 32 bp, Homo sapiens
tagccagtcagttttagtcactgtgaaatatt

SEQ ID NO: 7624 - DNA, 32 bp, Homo sapiens
caagggtgcccaggggtgtggtgtctctgagc

SEQ ID NO: 7625 - DNA, 32 bp, Homo sapiens
ctgtgtcgcccagactggagtgcagtggtggg

SEQ ID NO: 7626 - DNA, 32 bp, Homo sapiens
ctggcctcaagcaatcctcacgcctcagcctc

SEQ ID NO: 7627 - DNA, 32 bp, Homo sapiens
acagtctgaagaggaaggaagcagcagtatct

SEQ ID NO: 7628 - DNA, 32 bp, Homo sapiens
gaacctgggaggcagagggtgcagtaagctga

SEQ ID NO: 7629 - DNA, 32 bp, Homo sapiens
gaacccgggaggcagagggtgcagtaagccga

SEQ ID NO: 7630 - DNA, 32 bp, Homo sapiens
cagcctcatccctccaggtacaaacaagaaca

SEQ ID NO: 7631 - DNA, 32 bp, Homo sapiens
acaaagctttgcctgccacttctgcctccaga

SEQ ID NO: 7632 - DNA, 32 bp, Homo sapiens
gaatcaaatttccagaggtaagtggtgaaagg

SEQ ID NO: 7633 - DNA, 32 bp, Homo sapiens
ctctgttgcccagcctggagtgcagtggcatt

SEQ ID NO: 7634 - DNA, 32 bp, Homo sapiens
tccattgcgcccaggctggtatgcagtcatgt

SEQ ID NO: 7635 - DNA, 32 bp, Homo sapiens
ctcttgttacccaggcaggagtgcagtggcgt

SEQ ID NO: 7636 - DNA, 32 bp, Homo sapiens
ctaggccctaaaaggttttaattctttttcta

SEQ ID NO: 7637 - DNA, 32 bp, Homo sapiens
cttccccaacatcaggtctgcagagctgcagg

SEQ ID NO: 7638 - DNA, 28 bp, Homo sapiens
ggccacctgaatgctgccttatcacaag

SEQ ID NO: 7639 - DNA, 32 bp, Homo sapiens
tcagggtctagagtggagagaaatcggtaaga

SEQ ID NO: 7640 - DNA, 32 bp, Homo sapiens
tgaagtgcccagcgctggagtgcagcgtgcca

SEQ ID NO: 7641 - DNA, 32 bp, Homo sapiens
cctctttgcccagcttctcccctgccctattc

SEQ ID NO: 7642 - DNA, 32 bp, Homo sapiens
ctcctcagcttcctccccatctgggtgcccca

SEQ ID NO: 7643 - DNA, 24 bp, Homo sapiens
tcatgcctctaatcccagcacttt

SEQ ID NO: 7644 - DNA, 20 bp, Homo sapiens
ggctttaaaacatgctctct

SEQ ID NO: 7645 - DNA, 32 bp, Homo sapiens
ctcccctcagactagctttcagtcttctgtca

SEQ ID NO: 7646 - DNA, 32 bp, Homo sapiens
atgccccctttcagatgtcttctgcctgttat

SEQ ID NO: 7647 - DNA, 32 bp, Homo sapiens
ctctgtcacccaagctggtgtgcagtggtgtg

SEQ ID NO: 7648 - DNA, 32 bp, Homo sapiens
agccgaggaaggggagaaagccacaaccttca

SEQ ID NO: 7649 - DNA, 32 bp, Homo sapiens
gcctcacaacagcctccacaggcacagctcca

SEQ ID NO: 7650 - DNA, 32 bp, Homo sapiens
ttcctcgcacccagatggtagccagtcttcca

SEQ ID NO: 7651 - DNA, 32 bp, Homo sapiens
catgaaaactgcactttattgcaagttagtgt

SEQ ID NO: 7652 - DNA, 32 bp, Homo sapiens
agggcgaggcctggcagctgtagtgcttctgg

SEQ ID NO: 7653 - DNA, 32 bp, Homo sapiens
tctctggggaggcagtaaggggccgtggagct

SEQ ID NO: 7654 - DNA, 32 bp, Homo sapiens
gaatctctcagcgaccaggtgctgctgctgga

SEQ ID NO: 7655 - DNA, 32 bp, Homo sapiens
ttctgttgcctgggctggagtgcagtggcgtg

SEQ ID NO: 7656 - DNA, 32 bp, Homo sapiens
cgaaggtctgcagcttcactcctgagccagcg

SEQ ID NO: 7657 - DNA, 22 bp, Homo sapiens
tgtggggaggtgggactgagga

SEQ ID NO: 7658 - DNA, 32 bp, Homo sapiens
tgggtctcagttttccccatctggacccttgc

SEQ ID NO: 7659 - DNA, 32 bp, Homo sapiens
aaattaaggcttaaagaatgagcatggccaca

SEQ ID NO: 7660 - DNA, 32 bp, Homo sapiens
acacgtcccctgcctcaacaggcacagctctc

SEQ ID NO: 7661 - DNA, 32 bp, Homo sapiens
ctctgtagcccagtctggagtgcagtggtgtg

SEQ ID NO: 7662 - DNA, 32 bp, Homo sapiens
tcatgtctgcccagggggactgcgagttcctg

SEQ ID NO: 7663 - DNA, 32 bp, Homo sapiens
gcaccaagaacaatgctggagtgcagtggcgt

SEQ ID NO: 7664 - DNA, 32 bp, Homo sapiens
gttctgtttcccaggctggagtgcagtggtgg

SEQ ID NO: 7665 - DNA, 32 bp, Homo sapiens
acctcttcctccagggttcaagtgattctccc

SEQ ID NO: 7666 - DNA, 32 bp, Homo sapiens
gccgattcattccacgcagcagtattgggggt

SEQ ID NO: 7667 - DNA, 32 bp, Homo sapiens
ctcctgtcttcctccttgtcccatgaaggcca

SEQ ID NO: 7668 - DNA, 32 bp, Homo sapiens
acctccacctcttgggttcaagcgattctcct

SEQ ID NO: 7669 - DNA, 32 bp, Homo sapiens
accagcccaagtgccgtcttagccattcagtg

SEQ ID NO: 7670 - DNA, 32 bp, Homo sapiens
gagtccaggaggcggaggctgcagtgagctgt

SEQ ID NO: 7671 - DNA, 32 bp, Homo sapiens
ccaggttcaagagatcctcccacctcagcttc

SEQ ID NO: 7672 - DNA, 32 bp, Homo sapiens
tctatggctattgtgtcaggtcactgtggata

SEQ ID NO: 7673 - DNA, 23 bp, Homo sapiens
cacgcctgtaatcccagcacttt

SEQ ID NO: 7674 - DNA, 32 bp, Homo sapiens
tctttctggaaaagggaaagaaaatagtcttc

SEQ ID NO: 7675 - DNA, 32 bp, Homo sapiens
attctgtcactcaagctgtagtgcagtggtgc

SEQ ID NO: 7676 - DNA, 32 bp, Homo sapiens
ctcttggcctgagatctctgtgcaggaaccaa

SEQ ID NO: 7677 - DNA, 32 bp, Homo sapiens
caccttctgcaaggagctctgctgggccacct

SEQ ID NO: 7678 - DNA, 32 bp, Homo sapiens
ctgaacccaagtgtttatttaaatgtcaacag

SEQ ID NO: 7679 - DNA, 32 bp, Homo sapiens
atatgtgcaagtgcccttgacagagaggctgg

SEQ ID NO: 7680 - DNA, 32 bp, Homo sapiens
gctcctgcttcaggtgcagaaacacagctatt

SEQ ID NO: 7681 - DNA, 19 bp, Homo sapiens
cctgtaagcccagcacttt

SEQ ID NO: 7682 - DNA, 28 bp, Homo sapiens
ctgggcgcctgggctgcctcttcgcggg

SEQ ID NO: 7683 - DNA, 32 bp, Homo sapiens
gttgtaattgttccctttctgttttcatatag

SEQ ID NO: 7684 - DNA, 32 bp, Homo sapiens
attcatatgctgctgctgctgcagccaccaga

SEQ ID NO: 7685 - DNA, 32 bp, Homo sapiens
gggggctctgcagctgcccagctcttccagct

SEQ ID NO: 7686 - DNA, 32 bp, Homo sapiens
acctccgcctcccgggttcaagagattctcct

SEQ ID NO: 7687 - DNA, 32 bp, Homo sapiens
gaaataattaccaaccccttagcaataagcac

SEQ ID NO: 7688 - DNA, 32 bp, Homo sapiens
ccctgcagcctcagttttgaattcttttagca

SEQ ID NO: 7689 - DNA, 32 bp, Homo sapiens
agcctcccgagtagctggggttacaggcatgc

SEQ ID NO: 7690 - DNA, 32 bp, Homo sapiens
cattccttccttctcccatctggattcctaag

SEQ ID NO: 7691 - DNA, 32 bp, Homo sapiens
gggattggcccagcttggagtgcttgtgtggt

SEQ ID NO: 7692 - DNA, 32 bp, Homo sapiens
tatttagtatacctgaatcttggtttcttttt

SEQ ID NO: 7693 - DNA, 32 bp, Homo sapiens
cccacagccatggccatggcccagaaactcag

SEQ ID NO: 7694 - DNA, 32 bp, Homo sapiens
gctgactctgcagctcctcatgctggcctatc

SEQ ID NO: 7695 - DNA, 32 bp, Homo sapiens
ttccaacttcctcagtcttttctgcctcaact

SEQ ID NO: 7696 - DNA, 32 bp, Homo sapiens
gatgacccccatccctcataccatggagtcat

SEQ ID NO: 7697 - DNA, 32 bp, Homo sapiens
ccactacctgctagagcctactgtgaaatcac

SEQ ID NO: 7698 - DNA, 32 bp, Homo sapiens
catccgctccctccccagcaggcacagacatc

SEQ ID NO: 7699 - DNA, 32 bp, Homo sapiens
tcttgttgcccaggcttgagtgcagtgatgca

SEQ ID NO: 7700 - DNA, 32 bp, Homo sapiens
ctggcccttcaaggctggaagccagtgtccta

SEQ ID NO: 7701 - DNA, 18 bp, Homo sapiens
cagggaagcttcatgccc

SEQ ID NO: 7702 - DNA, 32 bp, Homo sapiens
cttctgagagcctcttctcgacactatcccac

SEQ ID NO: 7703 - DNA, 32 bp, Homo sapiens
tccagcccactgccactgggtgacacagactg

SEQ ID NO: 7704 - DNA, 32 bp, Homo sapiens
tcttgttacccaggctggagtgcagtggcgcg

SEQ ID NO: 7705 - DNA, 32 bp, Homo sapiens
tgttcaaatgttcttttaatggtcagtttaat

SEQ ID NO: 7706 - DNA, 32 bp, Homo sapiens
ttcttgttgcccagggctggagtgcagtggca

SEQ ID NO: 7707 - DNA, 32 bp, Homo sapiens
agatagtttgactgaacccccaccttgacctt

SEQ ID NO: 7708 - DNA, 32 bp, Homo sapiens
accttcgccacctgggttccagcaattctcct

SEQ ID NO: 7709 - DNA, 32 bp, Homo sapiens
acttccgactcccaggttcaagcgattctcct

SEQ ID NO: 7710 - DNA, 32 bp, Homo sapiens
gaagccaggaggcagaggttgcagttagccca

SEQ ID NO: 7711 - DNA, 32 bp, Homo sapiens
tgtttgagtgagtggctgagtgcagtgtcttt

SEQ ID NO: 7712 - DNA, 32 bp, Homo sapiens
tcaccatcaagcaatccatgtcatagggaaac

SEQ ID NO: 7713 - DNA, 22 bp, Homo sapiens
tcacgcctgtaatcccagccct

SEQ ID NO: 7714 - DNA, 28 bp, Homo sapiens
gtgcccactcgtgctgcctcttcttaac

SEQ ID NO: 7715 - DNA, 32 bp, Homo sapiens
tctatacactgggtgcccaacaacagcccctt

SEQ ID NO: 7716 - DNA, 32 bp, Homo sapiens
ttgacacagagttttgctcttgttgcccaggc

SEQ ID NO: 7717 - DNA, 32 bp, Homo sapiens
ccaacacctgtgctcctgacagctccatgcac

SEQ ID NO: 7718 - DNA, 32 bp, Homo sapiens
tctcatcatccctctagggacagcagggcagg

SEQ ID NO: 7719 - DNA, 32 bp, Homo sapiens
cttcactgtgtctttccatctgggctctgcag

SEQ ID NO: 7720 - DNA, 32 bp, Homo sapiens
atgaagggcttcaggctgggggcagtggacag

SEQ ID NO: 7721 - DNA, 32 bp, Homo sapiens
aaaaggaagtattagaaatgagctgaagacca

SEQ ID NO: 7722 - DNA, 32 bp, Homo sapiens
tagttattaagcaattgactttcacaccaact

SEQ ID NO: 7723 - DNA, 32 bp, Homo sapiens
ggctcttgcctgtaatcttagcactttgggag

SEQ ID NO: 7724 - DNA, 32 bp, Homo sapiens
ggcctcccaaagtgctgggattatacatgtga

SEQ ID NO: 7725 - DNA, 32 bp, Homo sapiens
ccgtggtctcaaggagtcagagcagggctggc

SEQ ID NO: 7726 - DNA, 32 bp, Homo sapiens
cagtatttaagtgcccataaggcagcatgaaa

SEQ ID NO: 7727 - DNA, 32 bp, Homo sapiens
gagcctgggaggcagaggttgctgtgagccga

SEQ ID NO: 7728 - DNA, 32 bp, Homo sapiens
acttgttttcctgtgttcttgttttcagaaaa

SEQ ID NO: 7729 - DNA, 32 bp, Homo sapiens
ttgagacagagtttcgctttgtcgcccaggct

SEQ ID NO: 7730 - DNA, 32 bp, Homo sapiens
gaacctgcctgagaacatttctaacggggagc

SEQ ID NO: 7731 - DNA, 32 bp, Homo sapiens
gcaggcctttgttttccaatggtgctatattc

SEQ ID NO: 7732 - DNA, 32 bp, Homo sapiens
taaaccattcatgcccttaaatagctagattt

SEQ ID NO: 7733 - DNA, 32 bp, Homo sapiens
aaaacacgactcctgaatcatgttccattact

SEQ ID NO: 7734 - DNA, 32 bp, Homo sapiens
atgagagctcagatggagatggtgctagaaga

SEQ ID NO: 7735 - DNA, 23 bp, Homo sapiens
tcacaccggtaatcccaacactt

SEQ ID NO: 7736 - DNA, 32 bp, Homo sapiens
aaagaaagagaaaagaaaagaaaagcaaccac

SEQ ID NO: 7737 - DNA, 32 bp, Homo sapiens
gtcatcagaagagggaggaggagcccaggcgt

SEQ ID NO: 7738 - DNA, 23 bp, Homo sapiens
cctctaagtctgcttgatagagt

SEQ ID NO: 7739 - DNA, 32 bp, Homo sapiens
ggcaggctgtgcaggagggttacttgagccca

SEQ ID NO: 7740 - DNA, 31 bp, Homo sapiens
gttacggaaatacgcgacaggagggagtatg

SEQ ID NO: 7741 - DNA, 32 bp, Homo sapiens
tgctctcgcccaggctggagtgcagtgggtgg

SEQ ID NO: 7742 - DNA, 32 bp, Homo sapiens
tgtctattgcccaggctggagtgcagtggtgc

SEQ ID NO: 7743 - DNA, 32 bp, Homo sapiens
agattgaggttagaggatcagtaggacatttt

SEQ ID NO: 7744 - DNA, 32 bp, Homo sapiens
tgctcacccagtgccctctcccctcagcctct

SEQ ID NO: 7745 - DNA, 32 bp, Homo sapiens
ctttgtcacccaggctggagtgcagtggtgtg

SEQ ID NO: 7746 - DNA, 32 bp, Homo sapiens
ctggcctcaagcagtcctcccacctcagcctc

SEQ ID NO: 7747 - DNA, 28 bp, Homo sapiens
ggatgccagagggctgcctctccagcgg

SEQ ID NO: 7748 - DNA, 32 bp, Homo sapiens
actccgccaagtgctaaccaaagctcagcaac

SEQ ID NO: 7749 - DNA, 32 bp, Homo sapiens
agaatattatcctggtttaacaacagtgccct

SEQ ID NO: 7750 - DNA, 32 bp, Homo sapiens
aggcctcctccctctgaccacagggtcatgcc

SEQ ID NO: 7751 - DNA, 23 bp, Homo sapiens
catgggcccggggcctgacccca

SEQ ID NO: 7752 - DNA, 32 bp, Homo sapiens
ctttgggagaggagaaaggagtttggcaggag

SEQ ID NO: 7753 - DNA, 32 bp, Homo sapiens
acttctaccacctaggttcaagcgattcttgt

SEQ ID NO: 7754 - DNA, 32 bp, Homo sapiens
ctctgtcgcccaggctggagtgcagtggcctg

SEQ ID NO: 7755 - DNA, 32 bp, Homo sapiens
gggctcctatcaggctgggtgtgcgagtgtcc

SEQ ID NO: 7756 - DNA, 32 bp, Homo sapiens
tttgtaaatcaagtattactggaacacaacca

SEQ ID NO: 7757 - DNA, 28 bp, Homo sapiens
gccagccctcgtgctgcctctggtccct

SEQ ID NO: 7758 - DNA, 32 bp, Homo sapiens
tttcagccaagtgcctgcccagagctctgcag

SEQ ID NO: 7759 - DNA, 32 bp, Homo sapiens
gaacccaggaggcggcggttgcagtgagccaa

SEQ ID NO: 7760 - DNA, 32 bp, Homo sapiens
ttgctgttccctcagctcccagctccacctct

SEQ ID NO: 7761 - DNA, 32 bp, Homo sapiens
tttcctcatcccttcacctgtggatggtcagg

SEQ ID NO: 7762 - DNA, 32 bp, Homo sapiens
ctggtgtcttcagcttctctgctgccatgttc

SEQ ID NO: 7763 - DNA, 24 bp, Homo sapiens
ctgaccaacatggtgaaacactgt

SEQ ID NO: 7764 - DNA, 32 bp, Homo sapiens
cccaggccccgggctgagcactgtgaggcctg

SEQ ID NO: 7765 - DNA, 24 bp, Homo sapiens
agagaggcaggattcctgctgact

SEQ ID NO: 7766 - DNA, 32 bp, Homo sapiens
ctcttgttacccaggctggagtgcaatggcac

SEQ ID NO: 7767 - DNA, 32 bp, Homo sapiens
ccctttctaagaggaggaaaaatggatgcaag

SEQ ID NO: 7768 - DNA, 32 bp, Homo sapiens
ttcctaagaagaggaaaatagcagaagagaag

SEQ ID NO: 7769 - DNA, 32 bp, Homo sapiens
gccccctgcccaggctgggtaagagatgggct

SEQ ID NO: 7770 - DNA, 32 bp, Homo sapiens
agcctccggagtagctgggattacaggcgtgc

SEQ ID NO: 7771 - DNA, 32 bp, Homo sapiens
agacattttcatctccccaaaaggagacccca

SEQ ID NO: 7772 - DNA, 32 bp, Homo sapiens
ggttgggggaggcagcgggtgatggctctgaa

SEQ ID NO: 7773 - DNA, 32 bp, Homo sapiens
cttgacgggaagcggaggttgcagtgagccga

SEQ ID NO: 7774 - DNA, 32 bp, Homo sapiens
tgccccctgccaggctgagggacagtgacaca

SEQ ID NO: 7775 - DNA, 22 bp, Homo sapiens
ggaccacagctgccagggactt

SEQ ID NO: 7776 - DNA, 32 bp, Homo sapiens
ttcggagcaggagacatccctgtgagcagaaa

SEQ ID NO: 7777 - DNA, 32 bp, Homo sapiens
ccggcgctctcgcctccctgccgaacacagcg

SEQ ID NO: 7778 - DNA, 32 bp, Homo sapiens
ggactcaggaggcggagtttgcagtgagctga

SEQ ID NO: 7779 - DNA, 32 bp, Homo sapiens
agcctccagagtagctgggattacaggcgccc

SEQ ID NO: 7780 - DNA, 32 bp, Homo sapiens
ctagtcccgggctggcgggagtgcagttctga

SEQ ID NO: 7781 - DNA, 32 bp, Homo sapiens
ggagggactggagaggaatgagattggccaaa

SEQ ID NO: 7782 - DNA, 32 bp, Homo sapiens
tgctggcaccccggtgcggaccacagagcaga

SEQ ID NO: 7783 - DNA, 32 bp, Homo sapiens
aggcccgggaggcgcaggcgcaggcgcagtgg

SEQ ID NO: 7784 - DNA, 32 bp, Homo sapiens
gcccttgggagtagctgggtgaatggacgatg

SEQ ID NO: 7785 - DNA, 32 bp, Homo sapiens
ctgaatagcaaggaccttctggaacataatct

SEQ ID NO: 7786 - DNA, 19 bp, Homo sapiens
gcccctgccccacacaggt

SEQ ID NO: 7787 - DNA, 17 bp, Homo sapiens
gcccctgccatcgcagg

SEQ ID NO: 7788 - DNA, 22 bp, Homo sapiens
tcacgcatgtaatcccagcact

SEQ ID NO: 7789 - DNA, 32 bp, Homo sapiens
gtttatgaatccattcccctgttttcagggac

SEQ ID NO: 7790 - DNA, 32 bp, Homo sapiens
tgagtgctttcctcttcttcaacactcaaccc

SEQ ID NO: 7791 - DNA, 31 bp, Homo sapiens
aatttggctacagccgctaggaggggatcgg

SEQ ID NO: 7792 - DNA, 32 bp, Homo sapiens
tcttgtcaaccagattggagtgcagtggtgca

SEQ ID NO: 7793 - DNA, 32 bp, Homo sapiens
gctctaccacccaggctggagtgcagtggtgt

SEQ ID NO: 7794 - DNA, 32 bp, Homo sapiens
ccacatccgaatctgtggcaccacagaggagc

SEQ ID NO: 7795 - DNA, 32 bp, Homo sapiens
gcagccccaacaagaacaggtacctgaacgtg

SEQ ID NO: 7796 - DNA, 32 bp, Homo sapiens
gaacccgcgaggcggagactgcagtgagccga

SEQ ID NO: 7797 - DNA, 32 bp, Homo sapiens
tcttgttgcccaggctggagtgcaatggtgcg

SEQ ID NO: 7798 - DNA, 32 bp, Homo sapiens
ctgggttgaagcaattcttctgcctcagcctc

SEQ ID NO: 7799 - DNA, 21 bp, Homo sapiens
caggacctgctcctgcctgaa

SEQ ID NO: 7800 - DNA, 28 bp, Homo sapiens
accgtgttcagtgctgcttcactctacc

SEQ ID NO: 7801 - DNA, 32 bp, Homo sapiens
aggtacccaagtggcctgaaacagtgtaggga

SEQ ID NO: 7802 - DNA, 32 bp, Homo sapiens
cttcatcaccttcaggcttcagtgtactgggt

SEQ ID NO: 7803 - DNA, 32 bp, Homo sapiens
attccaagctcgagagcttcagcctcaggaaa

SEQ ID NO: 7804 - DNA, 32 bp, Homo sapiens
ggagactctgcaggctccatccctccttattc

SEQ ID NO: 7805 - DNA, 32 bp, Homo sapiens
gtgtgagtgctgctctttccacctgccttgca

SEQ ID NO: 7806 - DNA, 32 bp, Homo sapiens
aagcttcaccgggccctccaggcacagagggg

SEQ ID NO: 7807 - DNA, 22 bp, Homo sapiens
ctgtaggaactactgtcccaga

SEQ ID NO: 7808 - DNA, 32 bp, Homo sapiens
aaaaatcacacaggctgggtgcagtggctcat

SEQ ID NO: 7809 - DNA, 32 bp, Homo sapiens
gcagccagggctggggaacactgtgaaagtta

SEQ ID NO: 7810 - DNA, 32 bp, Homo sapiens
cttttaaatgtgctgctcttcatttcaagatg

SEQ ID NO: 7811 - DNA, 32 bp, Homo sapiens
acctccacctcctgggttgaagtgattctcgt

SEQ ID NO: 7812 - DNA, 32 bp, Homo sapiens
gtctattgcccaggctggagtgcagtggtgcg

SEQ ID NO: 7813 - DNA, 32 bp, Homo sapiens
cccgcaaaatcaggcttgagtgcagtggcgca

SEQ ID NO: 7814 - DNA, 32 bp, Homo sapiens
ctgagctcaagtgatccacccacctcagcctc

SEQ ID NO: 7815 - DNA, 28 bp, Homo sapiens
cactgctcacacgctgcctcctcagcag

SEQ ID NO: 7816 - DNA, 32 bp, Homo sapiens
gatctcaggaggttgaggctgcagtgaattat

SEQ ID NO: 7817 - DNA, 32 bp, Homo sapiens
agctaggtggacagacccttgcagtgatgtcc

SEQ ID NO: 7818 - DNA, 32 bp, Homo sapiens
ccagtcacgttcctcaggcttacttgatctat

SEQ ID NO: 7819 - DNA, 21 bp, Homo sapiens
cgctcccggccccggccccgg

SEQ ID NO: 7820 - DNA, 31 bp, Homo sapiens
caacattacaaaggaaggaggagggaagaga

SEQ ID NO: 7821 - DNA, 32 bp, Homo sapiens
tcactcttgcccaggctgtagtgctgtggcac

SEQ ID NO: 7822 - DNA, 32 bp, Homo sapiens
atggccttagcctttgaaaatattttaaaata

SEQ ID NO: 7823 - DNA, 32 bp, Homo sapiens
agtggagccctctttccctgcagcctacattg

SEQ ID NO: 7824 - DNA, 32 bp, Homo sapiens
actctgtcacccaggctggagtgcagtggcga

SEQ ID NO: 7825 - DNA, 32 bp, Homo sapiens
gctctgtcgcccaggatggagtgcagtggcgc

SEQ ID NO: 7826 - DNA, 32 bp, Homo sapiens
ctcttgttgcccaggttggagtgtaatagcac

SEQ ID NO: 7827 - DNA, 32 bp, Homo sapiens
caccctcttctctcttctcttctccctgcccc

SEQ ID NO: 7828 - DNA, 32 bp, Homo sapiens
tgcccagagccagagggatggtggtagtcacg

SEQ ID NO: 7829 - DNA, 32 bp, Homo sapiens
tggtaacttctctgagcttcagtttccaagtg

SEQ ID NO: 7830 - DNA, 32 bp, Homo sapiens
tacatttctttatagcctcttctgatctctaa

SEQ ID NO: 7831 - DNA, 32 bp, Homo sapiens
gctctgtcgtccaggctggagtgcagtgactc

SEQ ID NO: 7832 - DNA, 32 bp, Homo sapiens
aaaacctccattctgtcagggcagaacagagc

SEQ ID NO: 7833 - DNA, 32 bp, Homo sapiens
actcaagatacttgccagtctctccagtgtgg

SEQ ID NO: 7834 - DNA, 32 bp, Homo sapiens
cctgcagagtccattccatcatgatgctgtgc

SEQ ID NO: 7835 - DNA, 32 bp, Homo sapiens
gctttgttgcccagactggagggcagtggcgc

SEQ ID NO: 7836 - DNA, 32 bp, Homo sapiens
gctctgtctcccaggctgaagtgcagtggcac

SEQ ID NO: 7837 - DNA, 32 bp, Homo sapiens
cgcctcccaagtagctgggattacaggtacct

SEQ ID NO: 7838 - DNA, 32 bp, Homo sapiens
gaggaggcacctgggagctgagcttaagagtt

SEQ ID NO: 7839 - DNA, 24 bp, Homo sapiens
ctgtcacccaagctggagtgcagt

SEQ ID NO: 7840 - DNA, 32 bp, Homo sapiens
gaaatgctgaagtatcggcattacatgtgttt

SEQ ID NO: 7841 - DNA, 28 bp, Homo sapiens
tttttaacaagtgctgggttattctgat

SEQ ID NO: 7842 - DNA, 32 bp, Homo sapiens
cgggttccagcaaattctcctgcctcagcctc

SEQ ID NO: 7843 - DNA, 32 bp, Homo sapiens
ctggcctcaagcaatcctcctacctcggcttt

SEQ ID NO: 7844 - DNA, 22 bp, Homo sapiens
gcaacagccttggggggcactt

SEQ ID NO: 7845 - DNA, 32 bp, Homo sapiens
ctatgctctaaaacatgaatgctttgttacag

SEQ ID NO: 7846 - DNA, 23 bp, Homo sapiens
tctgactgtccctgccaatgctc

SEQ ID NO: 7847 - DNA, 32 bp, Homo sapiens
ctctgccacccaggctggagtgcagtggtgca

SEQ ID NO: 7848 - DNA, 32 bp, Homo sapiens
actctgtcgctcaggctggagtgcagtgatgc

SEQ ID NO: 7849 - DNA, 32 bp, Homo sapiens
atacttttatatgattggcagtgcagtaagtt

SEQ ID NO: 7850 - DNA, 32 bp, Homo sapiens
aaatagcataagagcattttggaacacatcca

SEQ ID NO: 7851 - DNA, 32 bp, Homo sapiens
cgtttgtcgccaggctggagtgcagtggtgcc

SEQ ID NO: 7852 - DNA, 32 bp, Homo sapiens
ctttagagctgcactagcctggctttcttatt

SEQ ID NO: 7853 - DNA, 32 bp, Homo sapiens
ataccaagaaagcttcctctgtggaaatctgt

SEQ ID NO: 7854 - DNA, 32 bp, Homo sapiens
ggtcgctcttgggaggcacaggcatgggtgtg

SEQ ID NO: 7855 - DNA, 32 bp, Homo sapiens
atcccttttgcagcttttctttttggctctct

SEQ ID NO: 7856 - DNA, 28 bp, Homo sapiens
tactgtctcagtgctgctatatttaaga

SEQ ID NO: 7857 - DNA, 32 bp, Homo sapiens
ggcctcctgagtagctgggactacagggacta

SEQ ID NO: 7858 - DNA, 32 bp, Homo sapiens
agcctcccaagtagctgggattacagtgcctg

SEQ ID NO: 7859 - DNA, 32 bp, Homo sapiens
gaaaccaccacccaggttcaagcaattatcct

SEQ ID NO: 7860 - DNA, 32 bp, Homo sapiens
ctcttttgcccagactggagtgaagtagcatg

SEQ ID NO: 7861 - DNA, 32 bp, Homo sapiens
ggaaggagtcctgggagcatggctttccctga

SEQ ID NO: 7862 - DNA, 24 bp, Homo sapiens
ctgttgtccaggctggagtgcaat

SEQ ID NO: 7863 - DNA, 32 bp, Homo sapiens
aaacccaggaggtggaggttgcagtgagctga

SEQ ID NO: 7864 - DNA, 32 bp, Homo sapiens
gagcctgggaagtggaagttgcagtgagccaa

SEQ ID NO: 7865 - DNA, 32 bp, Homo sapiens
gaacctgggagatggaagttgcagtgaaccaa

SEQ ID NO: 7866 - DNA, 28 bp, Homo sapiens
cctgcctgaggtgctgcctcctcccagg

SEQ ID NO: 7867 - DNA, 32 bp, Homo sapiens
aaacccaggaggcggaggttgcagtgagttga

SEQ ID NO: 7868 - DNA, 32 bp, Homo sapiens
gaacctgggaggtggaagttgcagtgagccaa

SEQ ID NO: 7869 - DNA, 32 bp, Homo sapiens
caggtcagctcaggctggagcaggcatatgag

SEQ ID NO: 7870 - DNA, 24 bp, Homo sapiens
ctgttgtccaggctagagtgcagt

SEQ ID NO: 7871 - DNA, 32 bp, Homo sapiens
cagcagctcctccagctgcaccaccttcagca

SEQ ID NO: 7872 - DNA, 32 bp, Homo sapiens
tgtgatgccatcctgagggcttgcaaccagca

SEQ ID NO: 7873 - DNA, 32 bp, Homo sapiens
ggctacgaccgggaccacgtggtgctatggga

SEQ ID NO: 7874 - DNA, 32 bp, Homo sapiens
gctgtcacctgcaattctcccttatcagggcc

SEQ ID NO: 7875 - DNA, 24 bp, Homo sapiens
tgtggggaaaaggaaagatggggg

SEQ ID NO: 7876 - DNA, 18 bp, Homo sapiens
gcggccgcgcggcagctg

SEQ ID NO: 7877 - DNA, 32 bp, Homo sapiens
ctactcgggaggctgaggcaggagaatctctt

SEQ ID NO: 7878 - DNA, 32 bp, Homo sapiens
gctttgttgcccaggctggagtgccttggcgc

SEQ ID NO: 7879 - DNA, 32 bp, Homo sapiens
ttactctcgcccaggctagagtgcagtggcat

SEQ ID NO: 7880 - DNA, 32 bp, Homo sapiens
tcaccttcattcttcaattcagtctaggaaac

SEQ ID NO: 7881 - DNA, 32 bp, Homo sapiens
agggctggatgtagctgggattgagtccatgt

SEQ ID NO: 7882 - DNA, 32 bp, Homo sapiens
cccaatttagcatatctagactacctatttga

SEQ ID NO: 7883 - DNA, 24 bp, Homo sapiens
tcatgcctgtaatcccaccacttt

SEQ ID NO: 7884 - DNA, 21 bp, Homo sapiens
caggcatggctggtgcctgaa

SEQ ID NO: 7885 - DNA, 32 bp, Homo sapiens
gaacccgggaggcggaggctgcagtgagccga

SEQ ID NO: 7886 - DNA, 32 bp, Homo sapiens
ccatctctctccatatcaatctggaccatctc

SEQ ID NO: 7887 - DNA, 32 bp, Homo sapiens
tttctaagtcttctcctggatctacatttcca

SEQ ID NO: 7888 - DNA, 31 bp, Homo sapiens
ggactggagcagacgacgaggagggaagagt

SEQ ID NO: 7889 - DNA, 32 bp, Homo sapiens
tgtaagtttcagttgctgaatatatcagtata

SEQ ID NO: 7890 - DNA, 32 bp, Homo sapiens
tgtgaggtgctgctgtctctcctccagcaagg

SEQ ID NO: 7891 - DNA, 32 bp, Homo sapiens
gcgcccagcctccttccccacagggtctcgcc

SEQ ID NO: 7892 - DNA, 32 bp, Homo sapiens
gatgaccaggttctgtctctatggaagtcact

SEQ ID NO: 7893 - DNA, 32 bp, Homo sapiens
aagataaggaatatgcttatcttccaatttga

SEQ ID NO: 7894 - DNA, 22 bp, Homo sapiens
cttgttcttctgctgtagtgtg

SEQ ID NO: 7895 - DNA, 32 bp, Homo sapiens
agcctcccgagtagctgggattagaggcgtgt

SEQ ID NO: 7896 - DNA, 32 bp, Homo sapiens
ctgctggctcaaagctgggactacatgaaagt

SEQ ID NO: 7897 - DNA, 32 bp, Homo sapiens
gcatgcgggaggcggaggggtgggaccgggtg

SEQ ID NO: 7898 - DNA, 32 bp, Homo sapiens
ttgggttcaagcaattctgctgcatcagcctc

SEQ ID NO: 7899 - DNA, 32 bp, Homo sapiens
ccaatccttatcaattctcaccaccccataaa

SEQ ID NO: 7900 - DNA, 32 bp, Homo sapiens
tactgaaggcctgccccagctgatctcgctcg

SEQ ID NO: 7901 - DNA, 32 bp, Homo sapiens
ctgtctcatcccttgccaggagctcagggctg

SEQ ID NO: 7902 - DNA, 19 bp, Homo sapiens
gcaaaaagaacatgcttcc

SEQ ID NO: 7903 - DNA, 32 bp, Homo sapiens
ctgggatgtgcatcctgctccctgaacccttc

SEQ ID NO: 7904 - DNA, 32 bp, Homo sapiens
agatcccatggctgatgcctggaacacaatgt

SEQ ID NO: 7905 - DNA, 32 bp, Homo sapiens
gagacatcacccagtaggagggagtacggtct

SEQ ID NO: 7906 - DNA, 32 bp, Homo sapiens
cccggttcaagcaattctcctgcctcagcctc

SEQ ID NO: 7907 - DNA, 32 bp, Homo sapiens
agcctgctgagtagctgggattgcaggtgtgt

SEQ ID NO: 7908 - DNA, 32 bp, Homo sapiens
gaatccgggagatgcatgttgcagtgagctga

SEQ ID NO: 7909 - DNA, 32 bp, Homo sapiens
cactgttgcccaggctggagtgcagtggtgca

SEQ ID NO: 7910 - DNA, 32 bp, Homo sapiens
gctctgtctccaggctggagtgcagtggcgtc

SEQ ID NO: 7911 - DNA, 32 bp, Homo sapiens
agcccacagcttctcccagcctgaaaccaaca

SEQ ID NO: 7912 - DNA, 32 bp, Homo sapiens
ctgaaaagaagaggaggaggagagcgacggga

SEQ ID NO: 7913 - DNA, 28 bp, Homo sapiens
atggtctctagtgctgcctatcaacttg

SEQ ID NO: 7914 - DNA, 32 bp, Homo sapiens
gctctgttgcctgggctggagtgcagtgccac

SEQ ID NO: 7915 - DNA, 24 bp, Homo sapiens
ttttctggagaagacagagacaaa

SEQ ID NO: 7916 - DNA, 32 bp, Homo sapiens
cttactcatcttctagccttatgaccaggaac

SEQ ID NO: 7917 - DNA, 32 bp, Homo sapiens
gactttgctcccattccatactgtttttgtca

SEQ ID NO: 7918 - DNA, 32 bp, Homo sapiens
acacactgcccggctcagtgcagtgccccgcg

SEQ ID NO: 7919 - DNA, 32 bp, Homo sapiens
ctcttgttgtccaggctggagtgcagtggcgc

SEQ ID NO: 7920 - DNA, 32 bp, Homo sapiens
tgcttgctgttagagatgtagcactttatcct

SEQ ID NO: 7921 - DNA, 32 bp, Homo sapiens
cggcccaggcctgaaggggagctctgagacag

SEQ ID NO: 7922 - DNA, 32 bp, Homo sapiens
gaacccaggagacagaggttgtggtggggcaa

SEQ ID NO: 7923 - DNA, 32 bp, Homo sapiens
ctcttgtcgcccaggctggagtgcaacggtat

SEQ ID NO: 7924 - DNA, 32 bp, Homo sapiens
gtggcaaatcacttataaatggtgctgaagca

SEQ ID NO: 7925 - DNA, 21 bp, Homo sapiens
tcacgccagtaatcccagcac

SEQ ID NO: 7926 - DNA, 28 bp, Homo sapiens
gctggagccagtgctgcctgtccgtccc

SEQ ID NO: 7927 - DNA, 32 bp, Homo sapiens
gaacctgggaggtggaggttgcattgagccaa

SEQ ID NO: 7928 - DNA, 17 bp, Homo sapiens
cctctggccacccagga

SEQ ID NO: 7929 - DNA, 21 bp, Homo sapiens
ccaggctcacacagcagctca

SEQ ID NO: 7930 - DNA, 17 bp, Homo sapiens
ccctcaccgtccaggtg

SEQ ID NO: 7931 - DNA, 32 bp, Homo sapiens
ctcttgttgcccaggctggtgtgcaatggcgt

SEQ ID NO: 7932 - DNA, 32 bp, Homo sapiens
ctgaagcagagttttactcttgttgcccaggc

SEQ ID NO: 7933 - DNA, 32 bp, Homo sapiens
gggcctcatcccttctctcccaggtagcagaa

SEQ ID NO: 7934 - DNA, 32 bp, Homo sapiens
gagcccaggcctggcaggctcccagaacttga

SEQ ID NO: 7935 - DNA, 32 bp, Homo sapiens
gccttcctgagtagttgggaatacaggcatgc

SEQ ID NO: 7936 - DNA, 32 bp, Homo sapiens
acatccagctcctgggtttcagcaattctcct

SEQ ID NO: 7937 - DNA, 32 bp, Homo sapiens
gctctgtcacccaggttggagcacagtggtgc

SEQ ID NO: 7938 - DNA, 32 bp, Homo sapiens
ttcatttcagtcctttcccccacctcagcgtc

SEQ ID NO: 7939 - DNA, 32 bp, Homo sapiens
gagactgccgtgtcctccgagcactttgtttt

SEQ ID NO: 7940 - DNA, 32 bp, Homo sapiens
gcagtgggtgtgtggggaagtcactgtcccac

SEQ ID NO: 7941 - DNA, 28 bp, Homo sapiens
ttgacaccagtggaagcctcatcctcag

SEQ ID NO: 7942 - DNA, 32 bp, Homo sapiens
ctctgttgcccagcctggagtgcaatggcaca

SEQ ID NO: 7943 - DNA, 32 bp, Homo sapiens
actctgtcgcccaggctggagtgcagtggcat

SEQ ID NO: 7944 - DNA, 32 bp, Homo sapiens
actctgttgcccaggctagagtgcaatggcac

SEQ ID NO: 7945 - DNA, 32 bp, Homo sapiens
gctctgtcacccaggctagagtgcaatggcat

SEQ ID NO: 7946 - DNA, 32 bp, Homo sapiens
actctgttgcccaggctggagtgcagtggcac

SEQ ID NO: 7947 - DNA, 32 bp, Homo sapiens
gctctgtcacccaggctggagtacagtggcgt

SEQ ID NO: 7948 - DNA, 32 bp, Homo sapiens
gctctgtcacccaggctggagtgcagtggcat

SEQ ID NO: 7949 - DNA, 32 bp, Homo sapiens
acctccacctcccgggttcaagtgattctcat

SEQ ID NO: 7950 - DNA, 32 bp, Homo sapiens
acctccgcctcccgggttcaagtgattctcgt

SEQ ID NO: 7951 - DNA, 32 bp, Homo sapiens
ggagatggagtaattttgctgtggaaagactt

SEQ ID NO: 7952 - DNA, 32 bp, Homo sapiens
ttcaaagcaaatgtcttcctggattattcaaa

SEQ ID NO: 7953 - DNA, 32 bp, Homo sapiens
gggggtcaagacgtcccctgaggacccaggcc

SEQ ID NO: 7954 - DNA, 32 bp, Homo sapiens
ttctgccctccctgagcccacagggtcagtca

SEQ ID NO: 7955 - DNA, 32 bp, Homo sapiens
gggaatctgaggcagaggagggtgaggcctgt

SEQ ID NO: 7956 - DNA, 32 bp, Homo sapiens
gcccattttatgggctggagttaaatggaagt

SEQ ID NO: 7957 - DNA, 32 bp, Homo sapiens
acctgtgtcctctacttttctgatctcccaca

SEQ ID NO: 7958 - DNA, 32 bp, Homo sapiens
cgctctgtcgccaggctgaagtgcagtggcgc

SEQ ID NO: 7959 - DNA, 32 bp, Homo sapiens
ttctgccctaacctgacagaggtgtcatccac

SEQ ID NO: 7960 - DNA, 32 bp, Homo sapiens
ctgacctcaagcgatctgcccacctccgtctc

SEQ ID NO: 7961 - DNA, 32 bp, Homo sapiens
tcttgtcacctagactggagtgcaatggcgtg

SEQ ID NO: 7962 - DNA, 32 bp, Homo sapiens
ttctgtcactcaggctagagtgcagtggcatg

SEQ ID NO: 7963 - DNA, 32 bp, Homo sapiens
cctattcagtggtgctctcccacccaggggcc

SEQ ID NO: 7964 - DNA, 27 bp, Homo sapiens
ggatgggaaccggattggttgcagtgt

SEQ ID NO: 7965 - DNA, 32 bp, Homo sapiens
agcctggagatgtagaggctgcagtgagctgt

SEQ ID NO: 7966 - DNA, 32 bp, Homo sapiens
ctactcgggaggctgaggcaggagaatcattt

SEQ ID NO: 7967 - DNA, 32 bp, Homo sapiens
attcttagaagagtaagaacaaataaagtaca

SEQ ID NO: 7968 - DNA, 28 bp, Homo sapiens
aggttttccatgactgcctcatcagcag

SEQ ID NO: 7969 - DNA, 31 bp, Homo sapiens
aaccccatgggggacctcgacaacagcgcct

SEQ ID NO: 7970 - DNA, 19 bp, Homo sapiens
tggacacagcccactgcag

SEQ ID NO: 7971 - DNA, 32 bp, Homo sapiens
tgcgcccggcagtctggcgaccaccttgcggg

SEQ ID NO: 7972 - DNA, 24 bp, Homo sapiens
tcacacctgtgatcccaacatttt

SEQ ID NO: 7973 - DNA, 32 bp, Homo sapiens
actctgttgcccaggctggagtgcagtggtgg

SEQ ID NO: 7974 - DNA, 32 bp, Homo sapiens
tgcctgtcacccagttctgtggatgtgctggt

SEQ ID NO: 7975 - DNA, 32 bp, Homo sapiens
tcttagtcacccagactagaggtcagtggcag

SEQ ID NO: 7976 - DNA, 32 bp, Homo sapiens
ccaggttcacgccattctcccgcctcgggagc

SEQ ID NO: 7977 - DNA, 32 bp, Homo sapiens
cacccaggaactccctggcagtggattgtggg

SEQ ID NO: 7978 - DNA, 18 bp, Homo sapiens
caagctcagctcagcgtc

SEQ ID NO: 7979 - DNA, 32 bp, Homo sapiens
ttcctacatcttctcttcacctatcccttgta

SEQ ID NO: 7980 - DNA, 32 bp, Homo sapiens
gccccgtagcacaggcggagtgcagcggaggc

SEQ ID NO: 7981 - DNA, 32 bp, Homo sapiens
tagggaaagtttgtcaatttgttttcactata

SEQ ID NO: 7982 - DNA, 32 bp, Homo sapiens
ttgagacggagttttgctcttgtagcccaggc

SEQ ID NO: 7983 - DNA, 23 bp, Homo sapiens
tggctcgatctcagctcactgca

SEQ ID NO: 7984 - DNA, 32 bp, Homo sapiens
ccattttagcaacaggctaataaaatttcaaa

SEQ ID NO: 7985 - DNA, 32 bp, Homo sapiens
gctgtgtcgcctaggctggagtgcagtggcgt

SEQ ID NO: 7986 - DNA, 32 bp, Homo sapiens
gttctgtaacccaggctggagtgcagtggcct

SEQ ID NO: 7987 - DNA, 32 bp, Homo sapiens
caaaggtctgcagcttcactcctgaagccagc

SEQ ID NO: 7988 - DNA, 32 bp, Homo sapiens
aaactggtaacaggctgggtgcaatggctcac

SEQ ID NO: 7989 - DNA, 32 bp, Homo sapiens
tcttgttggctaggctggagtaaaatggtgcg

SEQ ID NO: 7990 - DNA, 32 bp, Homo sapiens
ttgacatggagtttcgctcttgtcacccaggc

SEQ ID NO: 7991 - DNA, 32 bp, Homo sapiens
cctccccagcccttggcacaggcagagttcgg

SEQ ID NO: 7992 - DNA, 32 bp, Homo sapiens
agcggcggctttagcgtcagtgactaggcagc

SEQ ID NO: 7993 - DNA, 32 bp, Homo sapiens
ggctcatgcctgtaatctcagcactttgagag

SEQ ID NO: 7994 - DNA, 32 bp, Homo sapiens
ttatgagctaccaaaactaaattctttctctg

SEQ ID NO: 7995 - DNA, 30 bp, Homo sapiens
atcacacctgtgagtggctcccagcacttt

SEQ ID NO: 7996 - DNA, 32 bp, Homo sapiens
gtctgtcgcccaggctggagtgcagtagcacg

SEQ ID NO: 7997 - DNA, 32 bp, Homo sapiens
tttgtacaaccctgacccgtttgctacatctt

SEQ ID NO: 7998 - DNA, 32 bp, Homo sapiens
agaaaggaggcggaactcggtgatctgactgg

SEQ ID NO: 7999 - DNA, 32 bp, Homo sapiens
gccataaaagagacactttcctgctggtggta

SEQ ID NO: 8000 - DNA, 25 bp, Homo sapiens
cgtcgcccaagctggagcgcaatgg

SEQ ID NO: 8001 - DNA, 32 bp, Homo sapiens
ctctgtcacccaagctggagtgcagtggtgca

SEQ ID NO: 8002 - DNA, 32 bp, Homo sapiens
taccacaggttcctgaataattcctgcagggc

SEQ ID NO: 8003 - DNA, 32 bp, Homo sapiens
ctgctacacatcctcgtgctttttacctcagt

SEQ ID NO: 8004 - DNA, 32 bp, Homo sapiens
aaagggcatttagaggaagaaggctgaaatca

SEQ ID NO: 8005 - DNA, 32 bp, Homo sapiens
tcctgggctcaagcagtccttctgccttagcc

SEQ ID NO: 8006 - DNA, 32 bp, Homo sapiens
ctctatcacccaggctggagtgcagtggtgca

SEQ ID NO: 8007 - DNA, 32 bp, Homo sapiens
acttccgcctcccggtttcaagcagttctcca

SEQ ID NO: 8008 - DNA, 32 bp, Homo sapiens
agcctcctgagtggctgggattacaggcgccc

SEQ ID NO: 8009 - DNA, 32 bp, Homo sapiens
tggaaaaaggagacggtggtgtggaaatggct

SEQ ID NO: 8010 - DNA, 32 bp, Homo sapiens
gatgttcaacatcactaataactagaagaaat

SEQ ID NO: 8011 - DNA, 32 bp, Homo sapiens
agcctcctgagtagctgggattacaggcaccc

SEQ ID NO: 8012 - DNA, 32 bp, Homo sapiens
agcctcccgagtagctgggattacaggcacct

SEQ ID NO: 8013 - DNA, 32 bp, Homo sapiens
agcctcccgagtagctgggattataggcaccc

SEQ ID NO: 8014 - DNA, 32 bp, Homo sapiens
ctagtcgggaggctgaggcaggagaatggcgt

SEQ ID NO: 8015 - DNA, 32 bp, Homo sapiens
ccgggttcaagcaattctcctgcctcagcttc

SEQ ID NO: 8016 - DNA, 32 bp, Homo sapiens
agcctcctgggtagctgggattacaagcaccc

SEQ ID NO: 8017 - DNA, 32 bp, Homo sapiens
ttctcacatcttctaaaccctggtccattctc

SEQ ID NO: 8018 - DNA, 28 bp, Homo sapiens
ctccacccagctgctgcctattccctgc

SEQ ID NO: 8019 - DNA, 32 bp, Homo sapiens
gaacccgggaagcggagcttgcagtgagccga

SEQ ID NO: 8020 - DNA, 32 bp, Homo sapiens
aaaaagcaaagactgaggtactgtgaatggag

SEQ ID NO: 8021 - DNA, 24 bp, Homo sapiens
acagatgtgcaccaccacactggc

SEQ ID NO: 8022 - DNA, 32 bp, Homo sapiens
aactcaagctcagcttctgcctcctgtctcct

SEQ ID NO: 8023 - DNA, 32 bp, Homo sapiens
ttcaggacatctcaagattcagtcttgacaat

SEQ ID NO: 8024 - DNA, 32 bp, Homo sapiens
cctcagtaaaagtcttctcccaactcagcctg

SEQ ID NO: 8025 - DNA, 32 bp, Homo sapiens
ctttctgttcacatttcatctgatttttaaac

SEQ ID NO: 8026 - DNA, 32 bp, Homo sapiens
taactcccagttctgagaagagccataggagt

SEQ ID NO: 8027 - DNA, 32 bp, Homo sapiens
aatctgcttgaatatttttatatttcacctcc

SEQ ID NO: 8028 - DNA, 32 bp, Homo sapiens
gcgagtcaacatcgtctttaactacgacatgc

SEQ ID NO: 8029 - DNA, 32 bp, Homo sapiens
tgaagcaaagacatcttcctggccacgtgttg

SEQ ID NO: 8030 - DNA, 32 bp, Homo sapiens
acctccgcctcccaggttcaagcgattttcct

SEQ ID NO: 8031 - DNA, 32 bp, Homo sapiens
tgaacctgagaggtgaggttgcagtgagccga

SEQ ID NO: 8032 - DNA, 32 bp, Homo sapiens
agagtggcaccaggctgagttaagtgggactg

SEQ ID NO: 8033 - DNA, 32 bp, Homo sapiens
gtaatccacatcctccatcttgagttactcct

SEQ ID NO: 8034 - DNA, 32 bp, Homo sapiens
cagaaaccaagtgctctagcctcagccctaaa

SEQ ID NO: 8035 - DNA, 32 bp, Homo sapiens
acacacccaagtgcccctcacacctcgtgcct

SEQ ID NO: 8036 - DNA, 32 bp, Homo sapiens
ggaaatccgagagtgagagagacatccaggct

SEQ ID NO: 8037 - DNA, 23 bp, Homo sapiens
tcatacctgtaatcccagcattt

SEQ ID NO: 8038 - DNA, 28 bp, Homo sapiens
tctgagccagatgctgcctgggtcggtt

SEQ ID NO: 8039 - DNA, 32 bp, Homo sapiens
gtatggaccagtgccctccgcagacagctcac

SEQ ID NO: 8040 - DNA, 32 bp, Homo sapiens
cgcagctggggcctggcacacagggtccctgt

SEQ ID NO: 8041 - DNA, 32 bp, Homo sapiens
gtgcacggcctgtgctgccttctgcctgggcc

SEQ ID NO: 8042 - DNA, 32 bp, Homo sapiens
aaaatggggatctcctccaaagagcagatttc

SEQ ID NO: 8043 - DNA, 32 bp, Homo sapiens
caatccccaacaattaggaactggaccctggg

SEQ ID NO: 8044 - DNA, 32 bp, Homo sapiens
atcgccactgccacctgcctcccgctgaatct

SEQ ID NO: 8045 - DNA, 32 bp, Homo sapiens
aatggcttgtgctcctgctcctgtgggtatag

SEQ ID NO: 8046 - DNA, 32 bp, Homo sapiens
ctcttttgcccaggctggatggagtgcagtgg

SEQ ID NO: 8047 - DNA, 32 bp, Homo sapiens
ccaggttcaggcaattctcctgcctcagcctc

SEQ ID NO: 8048 - DNA, 32 bp, Homo sapiens
ggctcatgcctgtaatcctagcactttgagag

SEQ ID NO: 8049 - DNA, 31 bp, Homo sapiens
gaatgactaacacatcctaggagggaaagtc

SEQ ID NO: 8050 - DNA, 19 bp, Homo sapiens
cctgtaataccagcacttt

SEQ ID NO: 8051 - DNA, 32 bp, Homo sapiens
tgagctccaagtgctaaataacagcatctcat

SEQ ID NO: 8052 - DNA, 32 bp, Homo sapiens
tcttgttgcccaggctagcatgcaatggtgtg

SEQ ID NO: 8053 - DNA, 32 bp, Homo sapiens
aataaccatcttctcaacatgacctgcttaac

SEQ ID NO: 8054 - DNA, 32 bp, Homo sapiens
gtgcttgctatctgtctcatgttacagagctt

SEQ ID NO: 8055 - DNA, 20 bp, Homo sapiens
cagggagggctgcccagccc

SEQ ID NO: 8056 - DNA, 19 bp, Homo sapiens
ccagtggctggagacttca

SEQ ID NO: 8057 - DNA, 32 bp, Homo sapiens
tcagcagcttggaagaaatcccagaagcggac

SEQ ID NO: 8058 - DNA, 32 bp, Homo sapiens
ccccacctgaagggtggatgtgctggaggggt

SEQ ID NO: 8059 - DNA, 32 bp, Homo sapiens
cttccagcctccacagctgacctccaagtcgg

SEQ ID NO: 8060 - DNA, 32 bp, Homo sapiens
ctacagacccttctgtcacagcacccaggagc

SEQ ID NO: 8061 - DNA, 32 bp, Homo sapiens
ggctcaagcctgtactcccagcacttttggag

SEQ ID NO: 8062 - DNA, 32 bp, Homo sapiens
aaacactttacaacctgctctctctctgaagt

SEQ ID NO: 8063 - DNA, 32 bp, Homo sapiens
tcccatgagtgccaagacggtgcaatgggtag

SEQ ID NO: 8064 - DNA, 32 bp, Homo sapiens
ctctatcgcccaggatggagtgcagtggctca

SEQ ID NO: 8065 - DNA, 32 bp, Homo sapiens
ccaggttcaagcaattctcccacctcagcctc

SEQ ID NO: 8066 - DNA, 20 bp, Homo sapiens
tcatgcctgtaatccctgca

SEQ ID NO: 8067 - DNA, 32 bp, Homo sapiens
aatctcgggaggcagaggttgcagtgagccga

SEQ ID NO: 8068 - DNA, 32 bp, Homo sapiens
ctactcgggaggctgaggcaggagaatagtgt

SEQ ID NO: 8069 - DNA, 32 bp, Homo sapiens
caggtcagctcaggctggagcaggtatatgag

SEQ ID NO: 8070 - DNA, 32 bp, Homo sapiens
tctctgtctcaaggagagcagggtaggtgaaa

SEQ ID NO: 8071 - DNA, 26 bp, Homo sapiens
tcatgcctgtataatcccagcacttt

SEQ ID NO: 8072 - DNA, 32 bp, Homo sapiens
caggagccaagaggaacaggaaaacaaatggc

SEQ ID NO: 8073 - DNA, 32 bp, Homo sapiens
ctaaagtgagttgatgaaaatatttgcaaaaa

SEQ ID NO: 8074 - DNA, 32 bp, Homo sapiens
gctcaagtgctgctctggcaaagctccggagc

SEQ ID NO: 8075 - DNA, 32 bp, Homo sapiens
ctctgtggcccaggctggagtgcagtggtgcg

SEQ ID NO: 8076 - DNA, 32 bp, Homo sapiens
gctttatcgcccaggctggagtacagtgatgc

SEQ ID NO: 8077 - DNA, 32 bp, Homo sapiens
actttgtcacccaggctagagtgcagtggtgc

SEQ ID NO: 8078 - DNA, 32 bp, Homo sapiens
agggatgctgtgctgctctcccatgagccagt

SEQ ID NO: 8079 - DNA, 32 bp, Homo sapiens
gacccttctggtgccctttgggaataaagctg

SEQ ID NO: 8080 - DNA, 32 bp, Homo sapiens
taggcccatggtgttcctgaatgtgattgaca

SEQ ID NO: 8081 - DNA, 32 bp, Homo sapiens
gctgtgtgaattcaggccttgtggaaaacacc

SEQ ID NO: 8082 - DNA, 24 bp, Homo sapiens
tcatgcctgtggtcccagcgcttt

SEQ ID NO: 8083 - DNA, 32 bp, Homo sapiens
cgttttaatttccaggacttgaactgccatgt

SEQ ID NO: 8084 - DNA, 28 bp, Homo sapiens
ccaggccaaagtgctgctgattcccact

SEQ ID NO: 8085 - DNA, 21 bp, Homo sapiens
gccatcacctagctgcctgaa

SEQ ID NO: 8086 - DNA, 24 bp, Homo sapiens
tcatgcctgtgatcccagcacttt

SEQ ID NO: 8087 - DNA, 24 bp, Homo sapiens
tcgtgcctgtaatcccagcacttt

SEQ ID NO: 8088 - DNA, 22 bp, Homo sapiens
ggaccaggcctggagggcactt

SEQ ID NO: 8089 - DNA, 32 bp, Homo sapiens
ccgcaaatgctgctgccccagctctacactgc

SEQ ID NO: 8090 - DNA, 32 bp, Homo sapiens
aagccatctctcccctgtgaggcacaggtggc

SEQ ID NO: 8091 - DNA, 32 bp, Homo sapiens
gctagagcctccaggccctatgatgctccctg

SEQ ID NO: 8092 - DNA, 32 bp, Homo sapiens
gggtgtggagtgaaagagtcactgtggtgggg

SEQ ID NO: 8093 - DNA, 32 bp, Homo sapiens
tcggttccagttctacttccagcagaaggggc

SEQ ID NO: 8094 - DNA, 32 bp, Homo sapiens
ttcctctgtaccactctgcttccttggacaat

SEQ ID NO: 8095 - DNA, 32 bp, Homo sapiens
ccatcagctccagacttcctgggacatctcgg

SEQ ID NO: 8096 - DNA, 23 bp, Homo sapiens
tcatgtatgtaatcctagcactt

SEQ ID NO: 8097 - DNA, 32 bp, Homo sapiens
gtacatcacggcttctctcccacgttaagact

SEQ ID NO: 8098 - DNA, 32 bp, Homo sapiens
ccttccggtctacaagagctctcaaggctggg

SEQ ID NO: 8099 - DNA, 32 bp, Homo sapiens
gcttgagcctgaggccttgtcgagaagcttcc

SEQ ID NO: 8100 - DNA, 32 bp, Homo sapiens
tcgtggcagctttgactgttggcatagccatt

SEQ ID NO: 8101 - DNA, 32 bp, Homo sapiens
gcttatctgttggcttctcttggcctgtggga

SEQ ID NO: 8102 - DNA, 32 bp, Homo sapiens
ctggtaccagttctgtaccatatgagaaagtt

SEQ ID NO: 8103 - DNA, 32 bp, Homo sapiens
agaaactgtctgctgctcaagacccacaggac

SEQ ID NO: 8104 - DNA, 32 bp, Homo sapiens
ttctggccttcagggtcacaggcagtaggggg

SEQ ID NO: 8105 - DNA, 32 bp, Homo sapiens
agcctcctgattagctgggactataggcgtgt

SEQ ID NO: 8106 - DNA, 32 bp, Homo sapiens
aagaaagactctattgtggttacttgaaaaat

SEQ ID NO: 8107 - DNA, 32 bp, Homo sapiens
caacccgggaggctgaggttgcagtgagtgga

SEQ ID NO: 8108 - DNA, 32 bp, Homo sapiens
aaacccaggcggcagaggttgcagtgagccaa

SEQ ID NO: 8109 - DNA, 19 bp, Homo sapiens
cagggagggagtccagccc

SEQ ID NO: 8110 - DNA, 23 bp, Homo sapiens
ttgagacggagtttcgctcttgt

SEQ ID NO: 8111 - DNA, 32 bp, Homo sapiens
gcgccatgaatcctgccacacagggatcaagg

SEQ ID NO: 8112 - DNA, 32 bp, Homo sapiens
ggtttgagtgttcttcatcagctgaccttaaa

SEQ ID NO: 8113 - DNA, 32 bp, Homo sapiens
taatggctgcctccctctcctgatctcttcaa

SEQ ID NO: 8114 - DNA, 32 bp, Homo sapiens
gctcagggcttggtacaatgagctgaattaga

SEQ ID NO: 8115 - DNA, 32 bp, Homo sapiens
gacacctaaggggacttccttacaacaccttg

SEQ ID NO: 8116 - DNA, 32 bp, Homo sapiens
ccagactcaagtgatccttccacctcagcctc

SEQ ID NO: 8117 - DNA, 32 bp, Homo sapiens
aggggtggggctgtgagctcttaatttgtttt

SEQ ID NO: 8118 - DNA, 32 bp, Homo sapiens
ctggaacactaatgaggaaactgcactgtttt

SEQ ID NO: 8119 - DNA, 32 bp, Homo sapiens
ctgacaatccttgagaatctttgcatgcagag

SEQ ID NO: 8120 - DNA, 32 bp, Homo sapiens
ggaggctgtgtccgtgggtgtgcagtgcccag

SEQ ID NO: 8121 - DNA, 32 bp, Homo sapiens
tgggcttcaagcaatcctcctgtgtcagccac

SEQ ID NO: 8122 - DNA, 28 bp, Homo sapiens
ttctgcccaagtggtaattcatcttggt

SEQ ID NO: 8123 - DNA, 32 bp, Homo sapiens
tggaggtggaggtggaggttgcagtgagccga

SEQ ID NO: 8124 - DNA, 32 bp, Homo sapiens
cggccacaggcaagggggttgcagtggccgcc

SEQ ID NO: 8125 - DNA, 32 bp, Homo sapiens
tttcagagtcttctcctctctctgatctctgt

SEQ ID NO: 8126 - DNA, 32 bp, Homo sapiens
agatgaagaagaggggtggggcaacaagtggt

SEQ ID NO: 8127 - DNA, 28 bp, Homo sapiens
gtaagaccttgggctgcctcttctgtct

SEQ ID NO: 8128 - DNA, 32 bp, Homo sapiens
ggattatcgcacagactgggaggtttagtggt

SEQ ID NO: 8129 - DNA, 32 bp, Homo sapiens
catctcgcccaccctggagagtgcagagctat

SEQ ID NO: 8130 - DNA, 32 bp, Homo sapiens
gccccctccagctcatgacactgtttggcctt

SEQ ID NO: 8131 - DNA, 32 bp, Homo sapiens
gttctgaggcctggtttgctcttaattaatat

SEQ ID NO: 8132 - DNA, 32 bp, Homo sapiens
agcctcctaaagtgctgggattataggcatga

SEQ ID NO: 8133 - DNA, 32 bp, Homo sapiens
atttagattatcatttatgtgctgttgcacag

SEQ ID NO: 8134 - DNA, 32 bp, Homo sapiens
gggatgctgatgggttggagtgcctaatggct

SEQ ID NO: 8135 - DNA, 32 bp, Homo sapiens
ccaggctcaagcaatcctaccatgtcagcctt

SEQ ID NO: 8136 - DNA, 24 bp, Homo sapiens
tcacacctgtaatcccggcacttt

SEQ ID NO: 8137 - DNA, 32 bp, Homo sapiens
ggaagaggaagaggaggacgaacagagatcct

SEQ ID NO: 8138 - DNA, 32 bp, Homo sapiens
gccttcgggaggcgagcaggcagcagttggcc

SEQ ID NO: 8139 - DNA, 32 bp, Homo sapiens
tctctgtcacccaggatggagtgcagtgttgt

SEQ ID NO: 8140 - DNA, 32 bp, Homo sapiens
gttagttgctctctgtcatagcccgcagaagc

SEQ ID NO: 8141 - DNA, 24 bp, Homo sapiens
tcacacctataatcccagcacttt

SEQ ID NO: 8142 - DNA, 32 bp, Homo sapiens
atctccgtgctcttctttgacaacagcgacaa

SEQ ID NO: 8143 - DNA, 32 bp, Homo sapiens
cctcctggccggcagagggcgcaggagcccag

SEQ ID NO: 8144 - DNA, 32 bp, Homo sapiens
ctatgtcaccgaggctacagtgcagtggttca

SEQ ID NO: 8145 - DNA, 32 bp, Homo sapiens
accgaacatcttctcgtgggcttactggccat

SEQ ID NO: 8146 - DNA, 23 bp, Homo sapiens
tcacgcctgtagtcccaacactt

SEQ ID NO: 8147 - DNA, 32 bp, Homo sapiens
acgggagcaggaggagaagatacgagagcagg

SEQ ID NO: 8148 - DNA, 19 bp, Homo sapiens
agatgactgaaccttgcag

SEQ ID NO: 8149 - DNA, 32 bp, Homo sapiens
tgtcagcagcttttcattcagctgaatgctct

SEQ ID NO: 8150 - DNA, 32 bp, Homo sapiens
aaaggtcagatctattggaaatgacagcccga

SEQ ID NO: 8151 - DNA, 32 bp, Homo sapiens
gagacggagtttccctcttgttgcccaggctg

SEQ ID NO: 8152 - DNA, 32 bp, Homo sapiens
aatgcagccctctccaccctccggccagcgag

SEQ ID NO: 8153 - DNA, 26 bp, Homo sapiens
ggccacagctgctgctggagtgcaat

SEQ ID NO: 8154 - DNA, 32 bp, Homo sapiens
attcagctgcccaggcagaggagaatggggtc

SEQ ID NO: 8155 - DNA, 32 bp, Homo sapiens
ctttctcgcacaggcttggagtgcagtggtgc

SEQ ID NO: 8156 - DNA, 32 bp, Homo sapiens
ctcgtgttgccccggctggagtgcagtggcgc

SEQ ID NO: 8157 - DNA, 32 bp, Homo sapiens
agcctccctagtagctgggattataggcgccc

SEQ ID NO: 8158 - DNA, 32 bp, Homo sapiens
ctttctaactgcactgcttacatgcgtattaa

SEQ ID NO: 8159 - DNA, 32 bp, Homo sapiens
gccgaaaccgatgtgtctatggtgctgcatct

SEQ ID NO: 8160 - DNA, 32 bp, Homo sapiens
ggctcatgcctgtaatcccagcactttgggga

SEQ ID NO: 8161 - DNA, 32 bp, Homo sapiens
tgccttgtttcaaatcatgtgctggctgtttt

SEQ ID NO: 8162 - DNA, 32 bp, Homo sapiens
ctctgtcacccaagctggagtgcagtggcacg

SEQ ID NO: 8163 - DNA, 32 bp, Homo sapiens
ctctgtcgcccaagctggagtgcagtggcaca

SEQ ID NO: 8164 - DNA, 18 bp, Homo sapiens
gcctgtaatcccagcact

SEQ ID NO: 8165 - DNA, 24 bp, Homo sapiens
tcagacctataatcccagcacttt

SEQ ID NO: 8166 - DNA, 24 bp, Homo sapiens
tcatgcccgtaatttctgcacttt

SEQ ID NO: 8167 - DNA, 32 bp, Homo sapiens
gtttggccccaagaagtgaatttgggtttgag

SEQ ID NO: 8168 - DNA, 32 bp, Homo sapiens
tcccgtagcccttcctggatctggagagagca

SEQ ID NO: 8169 - DNA, 32 bp, Homo sapiens
ttctgcctggtggtctttcttctgcctgctat

SEQ ID NO: 8170 - DNA, 32 bp, Homo sapiens
ctctgttgccccaggctggagtgcagtggtgt

SEQ ID NO: 8171 - DNA, 32 bp, Homo sapiens
tcactgttatccaggctggagtgcagaggcac

SEQ ID NO: 8172 - DNA, 32 bp, Homo sapiens
ctcttcatggtgctgctcctgctatggttcca

SEQ ID NO: 8173 - DNA, 32 bp, Homo sapiens
gagcccaggagtttgaggctgcagtgaactat

SEQ ID NO: 8174 - DNA, 32 bp, Homo sapiens
ggctcatgcctgtaatcccagcactttgcgag

SEQ ID NO: 8175 - DNA, 32 bp, Homo sapiens
ggctgatgcctgtaatcccagcactttgggag

SEQ ID NO: 8176 - DNA, 32 bp, Homo sapiens
atgcccacgcctagtcccatctgggcccccat

SEQ ID NO: 8177 - DNA, 24 bp, Homo sapiens
tcacgcctgtaatccctgcatttt

SEQ ID NO: 8178 - DNA, 28 bp, Homo sapiens
tgatccccaagtgtttcttgagcatctg

SEQ ID NO: 8179 - DNA, 32 bp, Homo sapiens
gctgtgttgcccaggctggagtgcaatggcgc

SEQ ID NO: 8180 - DNA, 32 bp, Homo sapiens
actctgttgcccagcctggagtgcagtggcat

SEQ ID NO: 8181 - DNA, 32 bp, Homo sapiens
ttgtgctctgcagcctttttcttctgaaaggc

SEQ ID NO: 8182 - DNA, 32 bp, Homo sapiens
ggcccttctcagttttctcccacattcacccc

SEQ ID NO: 8183 - DNA, 32 bp, Homo sapiens
agcctcctgagtagctgggactagaggcatgt

SEQ ID NO: 8184 - DNA, 32 bp, Homo sapiens
aggaggaagaattggcaggctaaagaagatga

SEQ ID NO: 8185 - DNA, 32 bp, Homo sapiens
ggctgtttcccaggctgaagtgcagtggcatg

SEQ ID NO: 8186 - DNA, 32 bp, Homo sapiens
aaagagcacatcctgataaatactttctctct

SEQ ID NO: 8187 - DNA, 32 bp, Homo sapiens
ctggcctcaagcagtcctcccaccttagcttc

SEQ ID NO: 8188 - DNA, 31 bp, Homo sapiens
gaaagacaagatgcaactaggaagagacaca

SEQ ID NO: 8189 - DNA, 32 bp, Homo sapiens
gaacccgggaggtggaggctgcagtgagccga

SEQ ID NO: 8190 - DNA, 32 bp, Homo sapiens
gaacccgggaggcggaggctgcagtgagtcga

SEQ ID NO: 8191 - DNA, 32 bp, Homo sapiens
ttgtgaaatgttctttcacttgtaagtttcag

SEQ ID NO: 8192 - DNA, 32 bp, Homo sapiens
cggccagggctgtctttcaaagtgccatgttc

SEQ ID NO: 8193 - DNA, 32 bp, Homo sapiens
aagctctctgcagctgtctcattccttcccaa

SEQ ID NO: 8194 - DNA, 32 bp, Homo sapiens
tgcctgaaaaattggccatggaggcacaccaa

SEQ ID NO: 8195 - DNA, 32 bp, Homo sapiens
gatcagcaacccttcctgctgctgctactgct

SEQ ID NO: 8196 - DNA, 32 bp, Homo sapiens
ctctctcacccaggctggagtgtaagtgacat

SEQ ID NO: 8197 - DNA, 32 bp, Homo sapiens
agcctcccgagtagctgggattacaagtgcgc

SEQ ID NO: 8198 - DNA, 32 bp, Homo sapiens
gaacctgggaggcagaggttgcagtgatccaa

SEQ ID NO: 8199 - DNA, 32 bp, Homo sapiens
tcatgcgggaggcaatgagctgctggagcaca

SEQ ID NO: 8200 - DNA, 32 bp, Homo sapiens
cagatttaaaatattaatttgctgctaattaa

SEQ ID NO: 8201 - DNA, 15 bp, Homo sapiens
gcccctgccctcagg

SEQ ID NO: 8202 - DNA, 32 bp, Homo sapiens
tccagaggaagaggaggaggcggcgaagcgtt

SEQ ID NO: 8203 - DNA, 28 bp, Homo sapiens
cctgtgcccactgctgcctctccatccc

SEQ ID NO: 8204 - DNA, 23 bp, Homo sapiens
ctgtctccaggctggagtgcagt

SEQ ID NO: 8205 - DNA, 32 bp, Homo sapiens
cagctcttgccagcttctctgacacttgggtt

SEQ ID NO: 8206 - DNA, 32 bp, Homo sapiens
cttttctgcatagtttttcttctgcttacttt

SEQ ID NO: 8207 - DNA, 32 bp, Homo sapiens
cgtaaaatagaagagcagtcactgtggaacta

SEQ ID NO: 8208 - DNA, 32 bp, Homo sapiens
tagctgctgctgctggctccactcctgcggtc

SEQ ID NO: 8209 - DNA, 32 bp, Homo sapiens
acttaacctctctgtgcttcagtctccctgtc

SEQ ID NO: 8210 - DNA, 32 bp, Homo sapiens
tctctttcaagtgccattacagctgaacatta

SEQ ID NO: 8211 - DNA, 32 bp, Homo sapiens
tccctgaagagtgccctggtcacagcaccctt

SEQ ID NO: 8212 - DNA, 24 bp, Homo sapiens
ctgtcacccaggctggagtccaat

SEQ ID NO: 8213 - DNA, 24 bp, Homo sapiens
tcacacctgtaatctcaacgcttt

SEQ ID NO: 8214 - DNA, 32 bp, Homo sapiens
ggggagaggagaggagaaatgtggacagaggg

SEQ ID NO: 8215 - DNA, 32 bp, Homo sapiens
cctctttcagttctgacagaaaataatttatt

SEQ ID NO: 8216 - DNA, 32 bp, Homo sapiens
cataggcctcaggagtcatcccagaagcagtg

SEQ ID NO: 8217 - DNA, 32 bp, Homo sapiens
ctctgccgcccaaactggagtgcagtggcaca

SEQ ID NO: 8218 - DNA, 32 bp, Homo sapiens
agcctcctgagtagctgggattataggcgaga

SEQ ID NO: 8219 - DNA, 32 bp, Homo sapiens
tgaaagacctatgagcaaatggtgctgaatac

SEQ ID NO: 8220 - DNA, 32 bp, Homo sapiens
tgagtgtgcctgtaatctcagcactttgaggg

SEQ ID NO: 8221 - DNA, 32 bp, Homo sapiens
tcaaacaggcctgggtatctgaggcttgcttg

SEQ ID NO: 8222 - DNA, 28 bp, Homo sapiens
ttcagttctcatgctgcctcttccaaaa

SEQ ID NO: 8223 - DNA, 32 bp, Homo sapiens
ccttgttgcccaggctggtcttgaactgggct

SEQ ID NO: 8224 - DNA, 32 bp, Homo sapiens
gagaaggactgcacttagaactgcattttggt

SEQ ID NO: 8225 - DNA, 23 bp, Homo sapiens
cacatctgtaatcccagcacttt

SEQ ID NO: 8226 - DNA, 23 bp, Homo sapiens
atctagtgctcacatgatctgaa

SEQ ID NO: 8227 - DNA, 32 bp, Homo sapiens
aggaggggacggggagaaagaagcaatgaatg

SEQ ID NO: 8228 - DNA, 24 bp, Homo sapiens
agcaaagcactgtgctgtgctcag

SEQ ID NO: 8229 - DNA, 32 bp, Homo sapiens
tgctctgtcgccaggctggagtgcagtggcgc

SEQ ID NO: 8230 - DNA, 32 bp, Homo sapiens
gcactgtcccccaggctggagtgcagtggcat

SEQ ID NO: 8231 - DNA, 32 bp, Homo sapiens
ctctgttgcccaggctggagtgcagtggcaca

SEQ ID NO: 8232 - DNA, 32 bp, Homo sapiens
ctctgtcacccaggctggagtgcagtggcatg

SEQ ID NO: 8233 - DNA, 23 bp, Homo sapiens
tgcagaatgaaatagaagcaaag

SEQ ID NO: 8234 - DNA, 32 bp, Homo sapiens
tatgcaaagagaagagaaagaaggatgcaatg

SEQ ID NO: 8235 - DNA, 32 bp, Homo sapiens
ctctgtcacccaggctggagtacagtggcgtg

SEQ ID NO: 8236 - DNA, 32 bp, Homo sapiens
ctctgtcacccaggctagagtgcaatggcatg

SEQ ID NO: 8237 - DNA, 32 bp, Homo sapiens
ggtcatcagcccagggcttcagtcttccttta

SEQ ID NO: 8238 - DNA, 24 bp, Homo sapiens
ggtctggtttgcagagcttgaaca

SEQ ID NO: 8239 - DNA, 32 bp, Homo sapiens
caggggagcagaaggagaagaaaactgcctgt

SEQ ID NO: 8240 - DNA, 32 bp, Homo sapiens
tagtcctgcagaggatttaactgtgaacctgg

SEQ ID NO: 8241 - DNA, 22 bp, Homo sapiens
tcgcccaggctggagtgcaatg

SEQ ID NO: 8242 - DNA, 32 bp, Homo sapiens
ccctgtcactcaggctggagcacagtggtgtg

SEQ ID NO: 8243 - DNA, 32 bp, Homo sapiens
ctctgttgcccaggctagagtgcaatggcaca

SEQ ID NO: 8244 - DNA, 32 bp, Homo sapiens
gctttgtcgcccaggctggagtgcagtggcag

SEQ ID NO: 8245 - DNA, 32 bp, Homo sapiens
agaatcctaagctctggaaatatttcatgaca

SEQ ID NO: 8246 - DNA, 32 bp, Homo sapiens
acctccgactcccaggttcaagcaattctcct

SEQ ID NO: 8247 - DNA, 32 bp, Homo sapiens
gtgacattccttctcccatctcttccttgaca

SEQ ID NO: 8248 - DNA, 28 bp, Homo sapiens
tgacaggcccaatgtgcctcattgagaa

SEQ ID NO: 8249 - DNA, 32 bp, Homo sapiens
tgcagcaatccaaaaggcagtttgtttggggt

SEQ ID NO: 8250 - DNA, 32 bp, Homo sapiens
gctctgtcacccaggctggagtgcaatggtga

SEQ ID NO: 8251 - DNA, 32 bp, Homo sapiens
cttaatcattgatccaggaatatttcaaccag

SEQ ID NO: 8252 - DNA, 24 bp, Homo sapiens
gggtggccagtttccatgtggctt

SEQ ID NO: 8253 - DNA, 32 bp, Homo sapiens
ccagacccaagtgatcctcccacctcagcctc

SEQ ID NO: 8254 - DNA, 32 bp, Homo sapiens
ccgacctcaggtgatctgcccacctcggcctc

SEQ ID NO: 8255 - DNA, 32 bp, Homo sapiens
ctggaggtgcagggggacctggaacatggatg

SEQ ID NO: 8256 - DNA, 17 bp, Homo sapiens
gcccctgcctcttcagg

SEQ ID NO: 8257 - DNA, 32 bp, Homo sapiens
tttaaccaggtactgtctaacaacagtcatct

SEQ ID NO: 8258 - DNA, 32 bp, Homo sapiens
gaccacgggaggcccaggtgcggagaggaggc

SEQ ID NO: 8259 - DNA, 32 bp, Homo sapiens
cattcttccctttggagaccagtctaggggtg

SEQ ID NO: 8260 - DNA, 32 bp, Homo sapiens
tgtcagatttgtgtcactcttctgccttcgtg

SEQ ID NO: 8261 - DNA, 32 bp, Homo sapiens
caagaccatcagagagcaaaccacatgttctg

SEQ ID NO: 8262 - DNA, 32 bp, Homo sapiens
tccatggctggcctgctcacagagctctacct

SEQ ID NO: 8263 - DNA, 32 bp, Homo sapiens
cctcaaggatcctctttctgaccatcaagcct

SEQ ID NO: 8264 - DNA, 32 bp, Homo sapiens
gctctgccatctgacagctcccagagggttct

SEQ ID NO: 8265 - DNA, 32 bp, Homo sapiens
gagaggaggctcgaggaatgaaccttggtctg

SEQ ID NO: 8266 - DNA, 22 bp, Homo sapiens
cccatcaccccccaacacacac

SEQ ID NO: 8267 - DNA, 32 bp, Homo sapiens
ggtgtggtgctgctccctcacctccaaaagag

SEQ ID NO: 8268 - DNA, 32 bp, Homo sapiens
gctttagagcagtggtcttcaaactttgaaag

SEQ ID NO: 8269 - DNA, 32 bp, Homo sapiens
ctcttgttgcctaggctggagtgcaatggtgc

SEQ ID NO: 8270 - DNA, 32 bp, Homo sapiens
cctctgtggcccaggctgaagagcagtagtgt

SEQ ID NO: 8271 - DNA, 32 bp, Homo sapiens
ccctgttgcccaagttggagtgcaatcttggc

SEQ ID NO: 8272 - DNA, 32 bp, Homo sapiens
aggtgtggcccaggcaggctgagtgggtgggc

SEQ ID NO: 8273 - DNA, 32 bp, Homo sapiens
tatcctctcccactttctcttccctctactca

SEQ ID NO: 8274 - DNA, 31 bp, Homo sapiens
aattccaacaacacaaccagcagagtgacac

SEQ ID NO: 8275 - DNA, 28 bp, Homo sapiens
ggtctcccaagtgcactcatccaggtca

SEQ ID NO: 8276 - DNA, 32 bp, Homo sapiens
agctgtgtccagggctggagtcagagcctgct

SEQ ID NO: 8277 - DNA, 32 bp, Homo sapiens
ttgagatggagtttctcttgtcaaccgggctg

SEQ ID NO: 8278 - DNA, 32 bp, Homo sapiens
ccagcggggagctgtttcaagagtaccggtac

SEQ ID NO: 8279 - DNA, 32 bp, Homo sapiens
aagctgtgcccaggaaggggagtaactgtgca

SEQ ID NO: 8280 - DNA, 32 bp, Homo sapiens
aggctgagcctcctgaaaacccatgaacgctg

SEQ ID NO: 8281 - DNA, 24 bp, Homo sapiens
tcacgtctgtaatcccagcacttt

SEQ ID NO: 8282 - DNA, 24 bp, Homo sapiens
tcacgcctgtaattccagcacttt

SEQ ID NO: 8283 - DNA, 32 bp, Homo sapiens
gtctcaaactcctgggctcaagcaatcctcct

SEQ ID NO: 8284 - DNA, 23 bp, Homo sapiens
ggtctgaaaggggtgtttgggca

SEQ ID NO: 8285 - DNA, 32 bp, Homo sapiens
ccccaaaacatcaccagtccctactacttgct

SEQ ID NO: 8286 - DNA, 19 bp, Homo sapiens
ccctggggccctccaggta

SEQ ID NO: 8287 - DNA, 32 bp, Homo sapiens
taaggggcctccatcccttttactcatttgta

SEQ ID NO: 8288 - DNA, 32 bp, Homo sapiens
tgctgtgtcaccaggatggagtgcagtggcat

SEQ ID NO: 8289 - DNA, 22 bp, Homo sapiens
cctacaaggcccatcgccacca

SEQ ID NO: 8290 - DNA, 32 bp, Homo sapiens
agcctcccaagtagctgggattacagattgat

SEQ ID NO: 8291 - DNA, 32 bp, Homo sapiens
gcccgcgggaggcccggggcagcggctgggat

SEQ ID NO: 8292 - DNA, 32 bp, Homo sapiens
ctttgtcgcccaggctggagtacagtggtgcg

SEQ ID NO: 8293 - DNA, 32 bp, Homo sapiens
agatttcaaatagtcctccccacctcaactgt

SEQ ID NO: 8294 - DNA, 24 bp, Homo sapiens
tcatgcctgtaatcctagcagctt

SEQ ID NO: 8295 - DNA, 32 bp, Homo sapiens
gaggaggggatgggagaaagtaggggatgtgg

SEQ ID NO: 8296 - DNA, 32 bp, Homo sapiens
gaacccaggaagtggaggttgcagtgagctaa

SEQ ID NO: 8297 - DNA, 32 bp, Homo sapiens
aattcgcatcttctctatccacatcatgacca

SEQ ID NO: 8298 - DNA, 32 bp, Homo sapiens
ttcccacatcttcctgtcttcttctgagcctt

SEQ ID NO: 8299 - DNA, 24 bp, Homo sapiens
tcatgcctgtaatcccaggacttt

SEQ ID NO: 8300 - DNA, 32 bp, Homo sapiens
gtcaagcttgcctcttcttgaggagcaccaac

SEQ ID NO: 8301 - DNA, 32 bp, Homo sapiens
acctagggaagcatgaaccacagggtccctga

SEQ ID NO: 8302 - DNA, 32 bp, Homo sapiens
gcagtggccccatcctggaacttgaccagatt

SEQ ID NO: 8303 - DNA, 32 bp, Homo sapiens
ctctgtcggccaggctggaatgcaatggtgcc

SEQ ID NO: 8304 - DNA, 32 bp, Homo sapiens
tctcaaagaaagaaagaaagaaaagaaagaaa

SEQ ID NO: 8305 - DNA, 32 bp, Homo sapiens
tgacactcagttctgtcactgtcaaggatgca

SEQ ID NO: 8306 - DNA, 32 bp, Homo sapiens
aggcagggcagccaggggctgcagtgaaatga

SEQ ID NO: 8307 - DNA, 32 bp, Homo sapiens
acagaaatacctgaaattcagtagtacttcat

SEQ ID NO: 8308 - DNA, 32 bp, Homo sapiens
agcctcctgagtagctgggattacagatcctg

SEQ ID NO: 8309 - DNA, 32 bp, Homo sapiens
gggtccagcttatcctgggtgctctgtgatca

SEQ ID NO: 8310 - DNA, 26 bp, Homo sapiens
tgtggggagagtggaagaggcaggga

SEQ ID NO: 8311 - DNA, 32 bp, Homo sapiens
gaacccagcagtgccctgccctgcagtctgag

SEQ ID NO: 8312 - DNA, 32 bp, Homo sapiens
gctctatggcccaggctggagtacagtgacac

SEQ ID NO: 8313 - DNA, 23 bp, Homo sapiens
gtcacccaggctgaagtgcagtg

SEQ ID NO: 8314 - DNA, 32 bp, Homo sapiens
gagcttgtactatacatctcccaaagaaaccc

SEQ ID NO: 8315 - DNA, 32 bp, Homo sapiens
tgctgctgcccaggctggagtgcagtggcacg

SEQ ID NO: 8316 - DNA, 19 bp, Homo sapiens
tgtggcccaccagtgtaat

SEQ ID NO: 8317 - DNA, 32 bp, Homo sapiens
agcctccctagtagctgggattacaggcacac

SEQ ID NO: 8318 - DNA, 22 bp, Homo sapiens
tcgcccaggctggagtgcagtg

SEQ ID NO: 8319 - DNA, 32 bp, Homo sapiens
ttccaacatcttcgttctttctcactgaccga

SEQ ID NO: 8320 - DNA, 31 bp, Homo sapiens
aacagcggtcccacaggcaggagggatctgg

SEQ ID NO: 8321 - DNA, 32 bp, Homo sapiens
ttagcaaccttcattccatctgcctccttcat

SEQ ID NO: 8322 - DNA, 32 bp, Homo sapiens
ggtgcctcttccactctggagtgaagttaatg

SEQ ID NO: 8323 - DNA, 32 bp, Homo sapiens
ggaaagcagaaatgaatgaactgtgaaagctc

SEQ ID NO: 8324 - DNA, 23 bp, Homo sapiens
ttgttgccaggctggagtgcagt

SEQ ID NO: 8325 - DNA, 32 bp, Homo sapiens
atcctcctgagtagctgggattacaggcgtgt

SEQ ID NO: 8326 - DNA, 32 bp, Homo sapiens
ccaacctcaggtgatccgcccacctcggcctc

SEQ ID NO: 8327 - DNA, 32 bp, Homo sapiens
ccgacctcaggtgatccgcccacctcagcctc

SEQ ID NO: 8328 - DNA, 32 bp, Homo sapiens
gccagtcgtgcacccacccccacgtccacccg

SEQ ID NO: 8329 - DNA, 24 bp, Homo sapiens
ctgtcttccaggctggagtgcagt

SEQ ID NO: 8330 - DNA, 32 bp, Homo sapiens
tggagatagcgctcctggagagggcagagtag

SEQ ID NO: 8331 - DNA, 32 bp, Homo sapiens
tttctctatagtgcaacaaacatggtttctca

SEQ ID NO: 8332 - DNA, 30 bp, Homo sapiens
tagagatggggtttcgctatgttggccaag

SEQ ID NO: 8333 - DNA, 32 bp, Homo sapiens
gaggcagtgctgctgctcccgcccgaggctca

SEQ ID NO: 8334 - DNA, 32 bp, Homo sapiens
cttcacctccttactggacacagggtcaaggg

SEQ ID NO: 8335 - DNA, 32 bp, Homo sapiens
tttgcaaacctgcaccttgcacttttgggttc

SEQ ID NO: 8336 - DNA, 32 bp, Homo sapiens
gctctgtcacccaagctggtgtgcagtggtgt

SEQ ID NO: 8337 - DNA, 32 bp, Homo sapiens
tccagacctcatgatttacccacctcggcctc

SEQ ID NO: 8338 - DNA, 32 bp, Homo sapiens
ggcacatgcctgtaatcccagcactttgggag

SEQ ID NO: 8339 - DNA, 21 bp, Homo sapiens
accctctccttgatgcagctt

SEQ ID NO: 8340 - DNA, 32 bp, Homo sapiens
ctccatcagccaggctggagtgcagtggtgca

SEQ ID NO: 8341 - DNA, 32 bp, Homo sapiens
ttctgtcacctaggctggaatgcagtggtgca

SEQ ID NO: 8342 - DNA, 32 bp, Homo sapiens
cagactgcaggcccatttggtgacacaggaca

SEQ ID NO: 8343 - DNA, 32 bp, Homo sapiens
gaatatgtgatgcactggaaatggcagaggct

SEQ ID NO: 8344 - DNA, 32 bp, Homo sapiens
tgcagtcattggagagagagctcctcatttct

SEQ ID NO: 8345 - DNA, 32 bp, Homo sapiens
actctgtcgcccaggctagagtgcagtggcac

SEQ ID NO: 8346 - DNA, 32 bp, Homo sapiens
ttgacacggagtttcgctcttgttgtccaggc

SEQ ID NO: 8347 - DNA, 32 bp, Homo sapiens
tatggagagccagcagggtctgggagttctcc

SEQ ID NO: 8348 - DNA, 30 bp, Homo sapiens
gagagatgagagaggccttcactgttcacc

SEQ ID NO: 8349 - DNA, 32 bp, Homo sapiens
tgggattggcccagcttggagtgcttgtgtgg

SEQ ID NO: 8350 - DNA, 32 bp, Homo sapiens
tcactgtcgcccaggctggagtgcagtggcgc

SEQ ID NO: 8351 - DNA, 32 bp, Homo sapiens
ttaagagatgttcttacagctggcctgggcat

SEQ ID NO: 8352 - DNA, 32 bp, Homo sapiens
acgtgtccctgaattccatctgactctaattt

SEQ ID NO: 8353 - DNA, 32 bp, Homo sapiens
ggggcagcctccagtctgctctcagcttgtgc

SEQ ID NO: 8354 - DNA, 24 bp, Homo sapiens
ggtttggtttccagacctgaggca

SEQ ID NO: 8355 - DNA, 32 bp, Homo sapiens
aatcccatttgaggtataagtcactcaggaag

SEQ ID NO: 8356 - DNA, 24 bp, Homo sapiens
tcacgcctgtaatcctagcatttt

SEQ ID NO: 8357 - DNA, 32 bp, Homo sapiens
gccaatatgctgctgtctccaatttcaataga

SEQ ID NO: 8358 - DNA, 21 bp, Homo sapiens
ctgtgggccactcgctgcaga

SEQ ID NO: 8359 - DNA, 32 bp, Homo sapiens
ccctgcccttgaggagcttcattgtagggaga

SEQ ID NO: 8360 - DNA, 32 bp, Homo sapiens
gccccagcctccatcttcgtctctcaggatgg

SEQ ID NO: 8361 - DNA, 32 bp, Homo sapiens
tgtagagaaaaatggtgaagaaaacaaagatg

SEQ ID NO: 8362 - DNA, 32 bp, Homo sapiens
tgtgtggatacttgttcaatactgctccaaaa

SEQ ID NO: 8363 - DNA, 32 bp, Homo sapiens
acctccacatcccaggttcaagtgattctcct

SEQ ID NO: 8364 - DNA, 32 bp, Homo sapiens
tctccggggaggcaggggtcctgcaggtcctg

SEQ ID NO: 8365 - DNA, 32 bp, Homo sapiens
acaacttcaagcatttttccagcgttaccatc

SEQ ID NO: 8366 - DNA, 32 bp, Homo sapiens
gggctcaagcctgtattccagcactttgggag

SEQ ID NO: 8367 - DNA, 32 bp, Homo sapiens
gcatgaaccccaggctggagtgcagtggctca

SEQ ID NO: 8368 - DNA, 32 bp, Homo sapiens
ggtcagagaagaggaaaagagactcagagaaa

SEQ ID NO: 8369 - DNA, 32 bp, Homo sapiens
ctgctcgggaggctgaggcaggagaatggcat

SEQ ID NO: 8370 - DNA, 32 bp, Homo sapiens
aacagctgttgactctagtactgtgaatccag

SEQ ID NO: 8371 - DNA, 32 bp, Homo sapiens
ctctgctagccagcagagtgagcatgcacagc

SEQ ID NO: 8372 - DNA, 32 bp, Homo sapiens
aggcctgtgctgctgccccacgctcaaactgt

SEQ ID NO: 8373 - DNA, 32 bp, Homo sapiens
ctcttgtcacccaggctggagtgcaatggcgc

SEQ ID NO: 8374 - DNA, 20 bp, Homo sapiens
ctaacacggtgaaacccgtc

SEQ ID NO: 8375 - DNA, 32 bp, Homo sapiens
agagtcctgtgggctgaaatatcagactggga

SEQ ID NO: 8376 - DNA, 32 bp, Homo sapiens
agtctactgcgtagctgggattacaggtgccc

SEQ ID NO: 8377 - DNA, 32 bp, Homo sapiens
gaaccagggaggcagagattgcagtgagccga

SEQ ID NO: 8378 - DNA, 32 bp, Homo sapiens
agcttcaaaccagactctgtgctgcttctgct

SEQ ID NO: 8379 - DNA, 32 bp, Homo sapiens
cagccctaccctgaattcctcagtgcgccgac

SEQ ID NO: 8380 - DNA, 32 bp, Homo sapiens
gaactggggaggcagaggttgcagtggcccga

SEQ ID NO: 8381 - DNA, 32 bp, Homo sapiens
gaacccgggaggcagaggttgcagtaagcaga

SEQ ID NO: 8382 - DNA, 32 bp, Homo sapiens
gggcacagagggcagaggttgggcggggtggg

SEQ ID NO: 8383 - DNA, 18 bp, Homo sapiens
cctgtaatcccagcactt

SEQ ID NO: 8384 - DNA, 32 bp, Homo sapiens
acagcgagaggcagagaaagaagagacaggag

SEQ ID NO: 8385 - DNA, 32 bp, Homo sapiens
ttcatgcctgggtggccaaacaacagtcttca

SEQ ID NO: 8386 - DNA, 32 bp, Homo sapiens
cgagggccaaccaccgagcaggcacagcacag

SEQ ID NO: 8387 - DNA, 32 bp, Homo sapiens
tttcttatttcaggagcttcataggcatagac

SEQ ID NO: 8388 - DNA, 32 bp, Homo sapiens
ggcaccccagtagctggccaccacctgcagtt

SEQ ID NO: 8389 - DNA, 20 bp, Homo sapiens
ggaagctgtccctgcccagt

SEQ ID NO: 8390 - DNA, 32 bp, Homo sapiens
acttggttagaattgtgctactgtgaacgctg

SEQ ID NO: 8391 - DNA, 32 bp, Homo sapiens
aacgcgctgctgctgctgctctatcggccgcc

SEQ ID NO: 8392 - DNA, 32 bp, Homo sapiens
ttagcacaggatccttccctggaacatcagca

SEQ ID NO: 8393 - DNA, 32 bp, Homo sapiens
ctgacctcaggtgatctacccacctcggcctc

SEQ ID NO: 8394 - DNA, 32 bp, Homo sapiens
ccaggttcaagcagttcttcctcagcctccgg

SEQ ID NO: 8395 - DNA, 32 bp, Homo sapiens
ttgacctcaggtgatccacccacctcggcctc

SEQ ID NO: 8396 - DNA, 28 bp, Homo sapiens
ccacccccaagtgcatgtctccatcact

SEQ ID NO: 8397 - DNA, 32 bp, Homo sapiens
tggaccctcagtgccctggcaacagctctgtg

SEQ ID NO: 8398 - DNA, 32 bp, Homo sapiens
ggacagaggtggagacaggtgcagtgacccag

SEQ ID NO: 8399 - DNA, 32 bp, Homo sapiens
tcctgcaccagacgtggggacagggtcctgag

SEQ ID NO: 8400 - DNA, 31 bp, Homo sapiens
cacagcaacaacagcaagaccatgggggagt

SEQ ID NO: 8401 - DNA, 28 bp, Homo sapiens
ctcctccacagtgctgcttctcttggga

SEQ ID NO: 8402 - DNA, 32 bp, Homo sapiens
tcagtggtgacggtggctgagagctcctggat

SEQ ID NO: 8403 - DNA, 24 bp, Homo sapiens
gccactggtttctcagaatccaaa

SEQ ID NO: 8404 - DNA, 19 bp, Homo sapiens
ggcaccacagatgctctcc

SEQ ID NO: 8405 - DNA, 32 bp, Homo sapiens
agtagaagcttgtggccgggtgcagtggctca

SEQ ID NO: 8406 - DNA, 24 bp, Homo sapiens
tcatgccagtaatcccagcacttt

SEQ ID NO: 8407 - DNA, 32 bp, Homo sapiens
tgaactaggaggcagaggttgcagtgagccga

SEQ ID NO: 8408 - DNA, 32 bp, Homo sapiens
tcctttcactgccttaatctttgcaacagggt

SEQ ID NO: 8409 - DNA, 32 bp, Homo sapiens
caataagagtctccttctcttctcttctttgg

SEQ ID NO: 8410 - DNA, 32 bp, Homo sapiens
acctcctctgcaggcccttccctctccgcctg

SEQ ID NO: 8411 - DNA, 32 bp, Homo sapiens
cttgatcgtgtgtttcattttctgcctctttg

SEQ ID NO: 8412 - DNA, 32 bp, Homo sapiens
gccaggatggtctcgatatctgatctcgtgat

SEQ ID NO: 8413 - DNA, 32 bp, Homo sapiens
tacaaacaaacctcgtcaccacggtcaggagg

SEQ ID NO: 8414 - DNA, 32 bp, Homo sapiens
attcccacccacgactcacaggcattcctccc

SEQ ID NO: 8415 - DNA, 32 bp, Homo sapiens
actgacagtttctgaggcagaagccgtatcat

SEQ ID NO: 8416 - DNA, 32 bp, Homo sapiens
gtgtctccaagatggccgcttggggaaggagg

SEQ ID NO: 8417 - DNA, 32 bp, Homo sapiens
gtgtcgcatcttctccagcgctgggccctccc

SEQ ID NO: 8418 - DNA, 24 bp, Homo sapiens
tcatgtttgtaatcctagcacttt

SEQ ID NO: 8419 - DNA, 19 bp, Homo sapiens
cccccaccccttgctctca

SEQ ID NO: 8420 - DNA, 23 bp, Homo sapiens
tggcacaacctcagctcactgca

SEQ ID NO: 8421 - DNA, 22 bp, Homo sapiens
gggagacccaggagcacctgga

SEQ ID NO: 8422 - DNA, 32 bp, Homo sapiens
gagctccactctgcttctctgacttctgcctg

SEQ ID NO: 8423 - DNA, 32 bp, Homo sapiens
tcagagatgtggtctcgctttgttgcctacac

SEQ ID NO: 8424 - DNA, 32 bp, Homo sapiens
atggcagggccagcagggaggtgggcatggca

SEQ ID NO: 8425 - DNA, 23 bp, Homo sapiens
tggcgcaacctcggctcactgca

SEQ ID NO: 8426 - DNA, 32 bp, Homo sapiens
gctgtgtcaccaggctggagcagtggcacgat

SEQ ID NO: 8427 - DNA, 32 bp, Homo sapiens
tctctggtactcaggctggagtgcggtggtgt

SEQ ID NO: 8428 - DNA, 32 bp, Homo sapiens
catgtctggtgtctgtcatgccaacctagaca

SEQ ID NO: 8429 - DNA, 32 bp, Homo sapiens
ggcctcccaaagtgctgggattaaggcgtgag

SEQ ID NO: 8430 - DNA, 32 bp, Homo sapiens
aatctcgcccaaacaggaaagcaaacctgaaa

SEQ ID NO: 8431 - DNA, 32 bp, Homo sapiens
tatatcagctaagtgttcctggaacataaaaa

SEQ ID NO: 8432 - DNA, 32 bp, Homo sapiens
tagacagctgagaggacctgatcatgtaggga

SEQ ID NO: 8433 - DNA, 32 bp, Homo sapiens
agcctcctgagtagctgggattataggcgtct

SEQ ID NO: 8434 - DNA, 32 bp, Homo sapiens
agcctcctgagtagctgggattacaggcgtcc

SEQ ID NO: 8435 - DNA, 32 bp, Homo sapiens
agccgggtcctgctgctcacaagcccagagct

SEQ ID NO: 8436 - DNA, 32 bp, Homo sapiens
ttcttacctcaaggctctgtctagccatgtta

SEQ ID NO: 8437 - DNA, 20 bp, Homo sapiens
gcctgttatcccagcacttt

SEQ ID NO: 8438 - DNA, 32 bp, Homo sapiens
catattaacaaatctgaaaatatgtcaaatta

SEQ ID NO: 8439 - DNA, 23 bp, Homo sapiens
tggcgcaatttcggctcactgca

SEQ ID NO: 8440 - DNA, 23 bp, Homo sapiens
tggcacaatttcagctcactgca

SEQ ID NO: 8441 - DNA, 32 bp, Homo sapiens
gcttgctccaattttccatctgctctctcttc

SEQ ID NO: 8442 - DNA, 32 bp, Homo sapiens
cacactgccaggggagcctcactgtgaagtct

SEQ ID NO: 8443 - DNA, 32 bp, Homo sapiens
ttagccccagttcctgcacgctccagggaacg

SEQ ID NO: 8444 - DNA, 32 bp, Homo sapiens
gaagttgaatatcagtctatagctaatgctac

SEQ ID NO: 8445 - DNA, 32 bp, Homo sapiens
gggaccagcagtctttctgataactgggagag

SEQ ID NO: 8446 - DNA, 32 bp, Homo sapiens
actttgccacctgtttgatgtgcagtggaaac

SEQ ID NO: 8447 - DNA, 32 bp, Homo sapiens
aaatgcaatgactggctgggtgcagtggctca

SEQ ID NO: 8448 - DNA, 32 bp, Homo sapiens
gttgtagctagagagccgctgtggaaaatatg

SEQ ID NO: 8449 - DNA, 32 bp, Homo sapiens
agctgggggaggcagtggcggctggagtaggt

SEQ ID NO: 8450 - DNA, 32 bp, Homo sapiens
ttttgtcacccaggctggagtgccatggcacg

SEQ ID NO: 8451 - DNA, 20 bp, Homo sapiens
gctcctccctgaccttcctc

SEQ ID NO: 8452 - DNA, 32 bp, Homo sapiens
ggacgggagccagcaggtcgcgttcgatgact

SEQ ID NO: 8453 - DNA, 32 bp, Homo sapiens
atttacttgccccactgctgtgcaatgcctta

SEQ ID NO: 8454 - DNA, 32 bp, Homo sapiens
gggggaggaagaggaagagaaaagaagaagaa

SEQ ID NO: 8455 - DNA, 32 bp, Homo sapiens
tgggtttgagctgggcttatcctccaactgtg

SEQ ID NO: 8456 - DNA, 32 bp, Homo sapiens
tagatttgctctattgaaaatgtttcattttt

SEQ ID NO: 8457 - DNA, 32 bp, Homo sapiens
ttgagacggagtttctctcttgttacccaggc

SEQ ID NO: 8458 - DNA, 32 bp, Homo sapiens
cacttcttgcccaggctggagtacaatggtgc

SEQ ID NO: 8459 - DNA, 32 bp, Homo sapiens
tgtgtgggcccagatggttgagcttgagcagg

SEQ ID NO: 8460 - DNA, 32 bp, Homo sapiens
ctgggcctcagagggccatgagcttggccagg

SEQ ID NO: 8461 - DNA, 24 bp, Homo sapiens
ctgttgtgcaggctggagtgcagt

SEQ ID NO: 8462 - DNA, 32 bp, Homo sapiens
ccatgaagatgatcttggctgtggagagccag

SEQ ID NO: 8463 - DNA, 32 bp, Homo sapiens
cgtagttggcaggagctcctggaagcacagcg

SEQ ID NO: 8464 - DNA, 32 bp, Homo sapiens
ctccatcacccaggctggagtccagtggtgtg

SEQ ID NO: 8465 - DNA, 32 bp, Homo sapiens
tgggcttcaagcactgtcttccatctgcatct

SEQ ID NO: 8466 - DNA, 32 bp, Homo sapiens
ctgggttcacgcaattctcctgcctcagcctc

SEQ ID NO: 8467 - DNA, 21 bp, Homo sapiens
gtgccaccggaagtgcaagga

SEQ ID NO: 8468 - DNA, 32 bp, Homo sapiens
gagcctgggaggttgaggctgcagtgagccat

SEQ ID NO: 8469 - DNA, 32 bp, Homo sapiens
gagcctgggaggtcaaggctgcagtgagctgt

SEQ ID NO: 8470 - DNA, 32 bp, Homo sapiens
cccgggagcatcaccgctttctggacctgtcc

SEQ ID NO: 8471 - DNA, 32 bp, Homo sapiens
tatctacatcttcacggtctctgagatcctga

SEQ ID NO: 8472 - DNA, 20 bp, Homo sapiens
gcctgtaatctcagcacttt

SEQ ID NO: 8473 - DNA, 32 bp, Homo sapiens
acctgcgtctaccttccatctgtgtccagcgg

SEQ ID NO: 8474 - DNA, 22 bp, Homo sapiens
cagagaagctatagttccagcc

SEQ ID NO: 8475 - DNA, 32 bp, Homo sapiens
gaggaggtgggccggcacacagctccagtgct

SEQ ID NO: 8476 - DNA, 32 bp, Homo sapiens
ctggagtccagcaatcctcccacctcaacctc

SEQ ID NO: 8477 - DNA, 32 bp, Homo sapiens
ctctttcgcccaggctggagtgcattggcatg

SEQ ID NO: 8478 - DNA, 32 bp, Homo sapiens
cagtacctcttcctgaatctggtacccatctg

SEQ ID NO: 8479 - DNA, 32 bp, Homo sapiens
atttcttgcccaggttccagtgtgtgttccaa

SEQ ID NO: 8480 - DNA, 32 bp, Homo sapiens
gtgtccagcagctacctcagtgacacccagag

SEQ ID NO: 8481 - DNA, 32 bp, Homo sapiens
caaattctttgatcttctcttccacctctctg

SEQ ID NO: 8482 - DNA, 32 bp, Homo sapiens
gaacccaggagatggaagttgcagtgagctga

SEQ ID NO: 8483 - DNA, 32 bp, Homo sapiens
ctcttcagctatttagactactgtgaaatgtt

SEQ ID NO: 8484 - DNA, 32 bp, Homo sapiens
gactcctgctcatccatcaaggcacagctcaa

SEQ ID NO: 8485 - DNA, 32 bp, Homo sapiens
aagttccctaacctctcccaacacagcctcca

SEQ ID NO: 8486 - DNA, 32 bp, Homo sapiens
actgtgtcatgcaggctggagtgaagtcgtgt

SEQ ID NO: 8487 - DNA, 32 bp, Homo sapiens
gctctgtcacccaggctggagtgtgcagtggc

SEQ ID NO: 8488 - DNA, 32 bp, Homo sapiens
gattagtttgcctaattcatgttttcacttaa

SEQ ID NO: 8489 - DNA, 32 bp, Homo sapiens
cccaaccccattgctaacaacatggtacattc

SEQ ID NO: 8490 - DNA, 32 bp, Homo sapiens
ctgggctcaagcaatcctcccacctcagcccg

SEQ ID NO: 8491 - DNA, 32 bp, Homo sapiens
agctccgcctcctgggttcacgtcattttcct

SEQ ID NO: 8492 - DNA, 32 bp, Homo sapiens
ctctgtcagccaggctggagtgtggtggcaca

SEQ ID NO: 8493 - DNA, 32 bp, Homo sapiens
tctcctggcccaggcctggcgggcactgcttc

SEQ ID NO: 8494 - DNA, 32 bp, Homo sapiens
atctgtcacccaggctggagtgcaatggcatg

SEQ ID NO: 8495 - DNA, 24 bp, Homo sapiens
tcacgcctgtaatccctacacttt

SEQ ID NO: 8496 - DNA, 32 bp, Homo sapiens
gaaccctggaggcagaggttgtggtgagtcga

SEQ ID NO: 8497 - DNA, 32 bp, Homo sapiens
gaacctgggaggcagagattgcagtgagccga

SEQ ID NO: 8498 - DNA, 19 bp, Homo sapiens
gaacccatgtgtgacagtc

SEQ ID NO: 8499 - DNA, 32 bp, Homo sapiens
agttctcatccctctgtcagggtcagtaagga

SEQ ID NO: 8500 - DNA, 32 bp, Homo sapiens
cagggctctgcagcacctcacctgagacctcc

SEQ ID NO: 8501 - DNA, 23 bp, Homo sapiens
tggcacagtctcagctcactgca

SEQ ID NO: 8502 - DNA, 21 bp, Homo sapiens
acaggcgtgagccaccgcggc

SEQ ID NO: 8503 - DNA, 32 bp, Homo sapiens
aggggtgtgctgcgtacagccccgatgaccac

SEQ ID NO: 8504 - DNA, 32 bp, Homo sapiens
gctcagtcgctcaggctggagtgcaatggtgg

SEQ ID NO: 8505 - DNA, 32 bp, Homo sapiens
gagtgaagaagaggaggagacgccaagcagag

SEQ ID NO: 8506 - DNA, 32 bp, Homo sapiens
tagcaaatggatctcagccactgttggagtgg

SEQ ID NO: 8507 - DNA, 32 bp, Homo sapiens
ttcactcccactgcctgggattgcactggatc

SEQ ID NO: 8508 - DNA, 32 bp, Homo sapiens
aaactatcaacaacaaggaagtctgctctgta

SEQ ID NO: 8509 - DNA, 32 bp, Homo sapiens
agagattaagactattctcccagtcccactac

SEQ ID NO: 8510 - DNA, 32 bp, Homo sapiens
tgctgtcacctgcactatccaattagtatttt

SEQ ID NO: 8511 - DNA, 32 bp, Homo sapiens
tccagaaagggttgctagccttaacttcagct

SEQ ID NO: 8512 - DNA, 28 bp, Homo sapiens
ctcggcctctgtgcagcctcatctcctg

SEQ ID NO: 8513 - DNA, 28 bp, Homo sapiens
ggtctctcaagtgcttatgcttttcttc

SEQ ID NO: 8514 - DNA, 32 bp, Homo sapiens
gaacccgggaggcggagattgcagtgagctga

SEQ ID NO: 8515 - DNA, 25 bp, Homo sapiens
gccagtcaacttcctggaatccaag

SEQ ID NO: 8516 - DNA, 32 bp, Homo sapiens
aatctgcatcttctcttatttctgaccttttt

SEQ ID NO: 8517 - DNA, 28 bp, Homo sapiens
atggctgtaagtgctggcctcatttcgc

SEQ ID NO: 8518 - DNA, 32 bp, Homo sapiens
cccttgatttcagctgaaaatattcatgtctg

SEQ ID NO: 8519 - DNA, 24 bp, Homo sapiens
tggcatgctctcagctcactgcag

SEQ ID NO: 8520 - DNA, 20 bp, Homo sapiens
tgggatctcagctcactgca

SEQ ID NO: 8521 - DNA, 32 bp, Homo sapiens
aagaagctgctggttctgtaccacaggcctca

SEQ ID NO: 8522 - DNA, 32 bp, Homo sapiens
gcaggcccagttctggaaaggccaggatgtgg

SEQ ID NO: 8523 - DNA, 32 bp, Homo sapiens
gtgcctagatgcctttgtatctctccatgtca

SEQ ID NO: 8524 - DNA, 32 bp, Homo sapiens
ctctcgttgccaaggctggagtgcaatggcac

SEQ ID NO: 8525 - DNA, 32 bp, Homo sapiens
attaagttataccagcaaaagtgcagtagtgt

SEQ ID NO: 8526 - DNA, 32 bp, Homo sapiens
aggcccagatctctaccacagaatacaccctg

SEQ ID NO: 8527 - DNA, 32 bp, Homo sapiens
agcctcctgagtagctgggactacaggcacct

SEQ ID NO: 8528 - DNA, 32 bp, Homo sapiens
cgtaaccagagacgctgggattagtgggtggg

SEQ ID NO: 8529 - DNA, 32 bp, Homo sapiens
caaaattagccgggcatggtggaacacacctg

SEQ ID NO: 8530 - DNA, 32 bp, Homo sapiens
ctctgtcgcccaggcgggaatgcagtggcgca

SEQ ID NO: 8531 - DNA, 32 bp, Homo sapiens
ccctagtcatagcctgtcatttgctacttttg

SEQ ID NO: 8532 - DNA, 32 bp, Homo sapiens
caggaggctgaggcaggagaattgtttgaacc

SEQ ID NO: 8533 - DNA, 32 bp, Homo sapiens
aaacccgggaagtggaggttgcagtgagccaa

SEQ ID NO: 8534 - DNA, 32 bp, Homo sapiens
gaacgcaggaggctgaggctgcagtgagttgt

SEQ ID NO: 8535 - DNA, 32 bp, Homo sapiens
ctctctcacccaggctggagtagagtgacaat

SEQ ID NO: 8536 - DNA, 32 bp, Homo sapiens
acattgtggatccgctaacaggcacagatgtc

SEQ ID NO: 8537 - DNA, 32 bp, Homo sapiens
attctgcatcccctccccatccaacctaaatg

SEQ ID NO: 8538 - DNA, 32 bp, Homo sapiens
gagcacgtatttctcccctctagtacctctgc

SEQ ID NO: 8539 - DNA, 32 bp, Homo sapiens
aaattgactgccaggctgggtgcagtggctca

SEQ ID NO: 8540 - DNA, 32 bp, Homo sapiens
actctgttgcccaggctgaggtacagtggcgt

SEQ ID NO: 8541 - DNA, 32 bp, Homo sapiens
tcttctgcttgaggaactgactgtgaagcgac

SEQ ID NO: 8542 - DNA, 32 bp, Homo sapiens
ccgggtccctgtgattttcccacctcagcctc

SEQ ID NO: 8543 - DNA, 32 bp, Homo sapiens
ccacagagcttggacttcctggaggacaagga

SEQ ID NO: 8544 - DNA, 32 bp, Homo sapiens
tggagtctcgctctctggagtgcaatggcgca

SEQ ID NO: 8545 - DNA, 32 bp, Homo sapiens
tctttaccattatgctcgatggtttgtttgtt

SEQ ID NO: 8546 - DNA, 32 bp, Homo sapiens
ccgggttcaagcaattctcccatctcagcctc

SEQ ID NO: 8547 - DNA, 32 bp, Homo sapiens
gaacctggaaggcagagattgcagtgagctga

SEQ ID NO: 8548 - DNA, 32 bp, Homo sapiens
agacccgggaggcagaggttgcagtgagccga

SEQ ID NO: 8549 - DNA, 32 bp, Homo sapiens
tcttgttgcctaggctggagtgcagtggcgca

SEQ ID NO: 8550 - DNA, 32 bp, Homo sapiens
aagagttactgatctatgaaatggcagagaat

SEQ ID NO: 8551 - DNA, 32 bp, Homo sapiens
aaaatcccaagtgacccacagaagctgtccta

SEQ ID NO: 8552 - DNA, 32 bp, Homo sapiens
gaacttgggagggagaggttgcagtgagccca

SEQ ID NO: 8553 - DNA, 32 bp, Homo sapiens
aagctgaccaaaacatggtccccaccttttgg

SEQ ID NO: 8554 - DNA, 32 bp, Homo sapiens
gaccctcaaacctacaccaaccaccttagatg

SEQ ID NO: 8555 - DNA, 20 bp, Homo sapiens
tgtgggttgcaagaggggga

SEQ ID NO: 8556 - DNA, 32 bp, Homo sapiens
tttgccatcgccaaggagtaggcacagggaca

SEQ ID NO: 8557 - DNA, 32 bp, Homo sapiens
cattttgcatcagcctggagtgaaccatgaac

SEQ ID NO: 8558 - DNA, 32 bp, Homo sapiens
agcctttttgaaggggacacagtctaggaggg

SEQ ID NO: 8559 - DNA, 32 bp, Homo sapiens
ttctgtcactcaggctggagtgcagtggcgtg

SEQ ID NO: 8560 - DNA, 32 bp, Homo sapiens
gctctattgttcagactggagtgcagtggcat

SEQ ID NO: 8561 - DNA, 32 bp, Homo sapiens
ggtctgttgcctaggcgggagtgcagtggcat

SEQ ID NO: 8562 - DNA, 32 bp, Homo sapiens
agggagtccacggagaagatgcagtgaatgct

SEQ ID NO: 8563 - DNA, 32 bp, Homo sapiens
ctctgtcacccaggctggactgcaatgacgcg

SEQ ID NO: 8564 - DNA, 32 bp, Homo sapiens
tcagcaaagagtgggccgctgtgtttggagac

SEQ ID NO: 8565 - DNA, 32 bp, Homo sapiens
cactgctggtgcccttctcttctgacctgctg

SEQ ID NO: 8566 - DNA, 32 bp, Homo sapiens
cgtctgcatcttcttctcagctgcctttccgc

SEQ ID NO: 8567 - DNA, 32 bp, Homo sapiens
ccgtatccagaaggatagtgatcatgtctagt

SEQ ID NO: 8568 - DNA, 32 bp, Homo sapiens
gagaacccagagcaatgacaccagtctggact

SEQ ID NO: 8569 - DNA, 32 bp, Homo sapiens
aatgtaaaagacctcaggcaccaccttcgcat

SEQ ID NO: 8570 - DNA, 32 bp, Homo sapiens
cacatttcttagcttctctgagcctccatttc

SEQ ID NO: 8571 - DNA, 32 bp, Homo sapiens
cgcatcctcttccatccccaggcacagatcaa

SEQ ID NO: 8572 - DNA, 32 bp, Homo sapiens
tcttgtctcccaggctggagtgcaatcgcgca

SEQ ID NO: 8573 - DNA, 32 bp, Homo sapiens
atgttcagcctatgatgaagtatttgattatt

SEQ ID NO: 8574 - DNA, 32 bp, Homo sapiens
cactctgtcgccaggctggagtgcagtggtgt

SEQ ID NO: 8575 - DNA, 32 bp, Homo sapiens
cgctctgtcacgaggctggagtgcagtggccc

SEQ ID NO: 8576 - DNA, 32 bp, Homo sapiens
agattggaacccagacttgcagtccagcgctg

SEQ ID NO: 8577 - DNA, 32 bp, Homo sapiens
ctctgtcacccaggctggagttatagtgacgt

SEQ ID NO: 8578 - DNA, 32 bp, Homo sapiens
tgctctgtcaccaggccggagtgcagtggtgt

SEQ ID NO: 8579 - DNA, 32 bp, Homo sapiens
cgctctgtcaccaggctggagtgcagtggtgt

SEQ ID NO: 8580 - DNA, 32 bp, Homo sapiens
cttttctacctgctctatacttggcactcaat

SEQ ID NO: 8581 - DNA, 32 bp, Homo sapiens
tcaggagctcaaggctggagtgtcttgacagt

SEQ ID NO: 8582 - DNA, 32 bp, Homo sapiens
ctctgttacccaggctggagtgtagtggtgcc

SEQ ID NO: 8583 - DNA, 32 bp, Homo sapiens
tctgtttcccccagactcctggagttctagtc

SEQ ID NO: 8584 - DNA, 32 bp, Homo sapiens
gcctcccaccctccctgcaacaacagccctct

SEQ ID NO: 8585 - DNA, 32 bp, Homo sapiens
ctcctcgggaggcaggagaatcgcttgaaccc

SEQ ID NO: 8586 - DNA, 32 bp, Homo sapiens
ctttgtcgcccaggctggagtgcagtggcagt

SEQ ID NO: 8587 - DNA, 21 bp, Homo sapiens
aaagaaaagaaatctacctca

SEQ ID NO: 8588 - DNA, 32 bp, Homo sapiens
gaccagcttcaaggagcggaaggctggcttga

SEQ ID NO: 8589 - DNA, 32 bp, Homo sapiens
aatgcccgtattaggaggattacttgagccct

SEQ ID NO: 8590 - DNA, 32 bp, Homo sapiens
tcttgttgcccaggctggagtgcgttggcgtg

SEQ ID NO: 8591 - DNA, 32 bp, Homo sapiens
acaaagctagttctgtcttttcagaagtccta

SEQ ID NO: 8592 - DNA, 23 bp, Homo sapiens
accccaggaatggcttcaacaga

SEQ ID NO: 8593 - DNA, 32 bp, Homo sapiens
ggctcatgcctgtaatgccagcactttgccaa

SEQ ID NO: 8594 - DNA, 23 bp, Homo sapiens
tgtggcccaggctggagtgcagt

SEQ ID NO: 8595 - DNA, 24 bp, Homo sapiens
aaaggttttaaccgcacatgcaca

SEQ ID NO: 8596 - DNA, 19 bp, Homo sapiens
gcccctgctgtgcctggta

SEQ ID NO: 8597 - DNA, 28 bp, Homo sapiens
gcaggctccagtggggcctcatcataca

SEQ ID NO: 8598 - DNA, 32 bp, Homo sapiens
cccgctgcctccatttctctagatctgtgctc

SEQ ID NO: 8599 - DNA, 32 bp, Homo sapiens
tagcacccagcctgcatctcccaggaggaagt

SEQ ID NO: 8600 - DNA, 32 bp, Homo sapiens
acctggcatcttctgccctgttcatctacgga

SEQ ID NO: 8601 - DNA, 32 bp, Homo sapiens
atctaggtgtccacctgcgtctgtggaagaag

SEQ ID NO: 8602 - DNA, 32 bp, Homo sapiens
ttggcctcaaattatctgcccacctcggcctc

SEQ ID NO: 8603 - DNA, 32 bp, Homo sapiens
aacctgcctcccactactgagcacttaccgaa

SEQ ID NO: 8604 - DNA, 32 bp, Homo sapiens
tgataaatggtgagatttgaatgtgataagca

SEQ ID NO: 8605 - DNA, 32 bp, Homo sapiens
ttctgtcgccctggctggagtggaatgccgtg

SEQ ID NO: 8606 - DNA, 32 bp, Homo sapiens
tccactggcacttccctgctttgctaccatcg

SEQ ID NO: 8607 - DNA, 32 bp, Homo sapiens
taccaccaccgatttaaatgggctgagttggg

SEQ ID NO: 8608 - DNA, 32 bp, Homo sapiens
agggaaagtttagacatctgcagagaggcagg

SEQ ID NO: 8609 - DNA, 32 bp, Homo sapiens
taggaaaagagaggagagaaaagcaactgagt

SEQ ID NO: 8610 - DNA, 32 bp, Homo sapiens
tctgtcgcccagggctggagtgcagtggcgcg

SEQ ID NO: 8611 - DNA, 32 bp, Homo sapiens
gtataagcctccatatgtctcatctgtgctct

SEQ ID NO: 8612 - DNA, 32 bp, Homo sapiens
gcaggaagaaggcaggcttctggcttccagag

SEQ ID NO: 8613 - DNA, 32 bp, Homo sapiens
acaaaatagaggagagaaagagagcatgagag

SEQ ID NO: 8614 - DNA, 32 bp, Homo sapiens
gaagtttgaggccaaacccccagcggtcagtg

SEQ ID NO: 8615 - DNA, 32 bp, Homo sapiens
agcctcccgagtagctgggactactggtacat

SEQ ID NO: 8616 - DNA, 32 bp, Homo sapiens
gatttcctcaaagacaacaactacctgcccta

SEQ ID NO: 8617 - DNA, 32 bp, Homo sapiens
ccaggcatgatcttccccatcaggctgggctc

SEQ ID NO: 8618 - DNA, 32 bp, Homo sapiens
tcccacgtgttctttcccatctggcggccgcg

SEQ ID NO: 8619 - DNA, 32 bp, Homo sapiens
ccgccgccccgctccctgctttgctacacaaa

SEQ ID NO: 8620 - DNA, 18 bp, Homo sapiens
ggaactcacacgcagtcc

SEQ ID NO: 8621 - DNA, 32 bp, Homo sapiens
catcacggcactctgggacaggcacggaggac

SEQ ID NO: 8622 - DNA, 32 bp, Homo sapiens
ctctgtcacacaggctggagtgcagtggtgtg

SEQ ID NO: 8623 - DNA, 32 bp, Homo sapiens
cccccaagtgtttaataactggcattaagctt

SEQ ID NO: 8624 - DNA, 23 bp, Homo sapiens
tggcatgatctggtctcactgca

SEQ ID NO: 8625 - DNA, 32 bp, Homo sapiens
ctgctggtgctgctgctgctgctgctgcccac

SEQ ID NO: 8626 - DNA, 32 bp, Homo sapiens
ggctcatgcctgtaatcctagcactttgggtg

SEQ ID NO: 8627 - DNA, 32 bp, Homo sapiens
gaagcctgggtaaaattgtattacatgatctt

SEQ ID NO: 8628 - DNA, 32 bp, Homo sapiens
tcgctgggaacgcacttcctgggacgctgaga

SEQ ID NO: 8629 - DNA, 32 bp, Homo sapiens
ctgacctcaggtgatccgcccacctcagcctc

SEQ ID NO: 8630 - DNA, 32 bp, Homo sapiens
ctgacctcaagtgatccacccacctcagcctc

SEQ ID NO: 8631 - DNA, 32 bp, Homo sapiens
ctaacctcaggtgatccgcccacctcggcctc

SEQ ID NO: 8632 - DNA, 32 bp, Homo sapiens
aaggaatgtgaggaagaaagaaaggcagggca

SEQ ID NO: 8633 - DNA, 28 bp, Homo sapiens
taagcagtcaatgctgcctcatttattg

SEQ ID NO: 8634 - DNA, 32 bp, Homo sapiens
tcttgtcacctaggcaagagtgcaatggcaca

SEQ ID NO: 8635 - DNA, 22 bp, Homo sapiens
ggcgctatctcggctcgctgca

SEQ ID NO: 8636 - DNA, 32 bp, Homo sapiens
tgacgagacatcgttcataaggcacagcacat

SEQ ID NO: 8637 - DNA, 19 bp, Homo sapiens
cctgtaatcccagtacttt

SEQ ID NO: 8638 - DNA, 32 bp, Homo sapiens
atttaaaatgttcttcgggggagaagggagct

SEQ ID NO: 8639 - DNA, 32 bp, Homo sapiens
gctctgtcatccaaactggagtgcagtggcac

SEQ ID NO: 8640 - DNA, 32 bp, Homo sapiens
tgaccccctacttggctctttccagggagcat

SEQ ID NO: 8641 - DNA, 32 bp, Homo sapiens
aaattgtaagatcagtctggtactgaataaaa

SEQ ID NO: 8642 - DNA, 32 bp, Homo sapiens
tcttgttgtccagtctggagtgcaatggcaca

SEQ ID NO: 8643 - DNA, 32 bp, Homo sapiens
gtctggggctcaggctggtgtgggatgcagcc

SEQ ID NO: 8644 - DNA, 32 bp, Homo sapiens
tcatcttacctgtaatcctagcactttgagac

SEQ ID NO: 8645 - DNA, 32 bp, Homo sapiens
aaactcactcagtatcatgacaacagcatggg

SEQ ID NO: 8646 - DNA, 32 bp, Homo sapiens
gaacccaggagttggagcttgcagtgagccga

SEQ ID NO: 8647 - DNA, 32 bp, Homo sapiens
ctacttgggaggcagaggcaggagaatggcat

SEQ ID NO: 8648 - DNA, 32 bp, Homo sapiens
cgtgtatattttctcccccaatgaatcaattg

SEQ ID NO: 8649 - DNA, 32 bp, Homo sapiens
gaaaaggagttaggagaaagaagagcagctga

SEQ ID NO: 8650 - DNA, 32 bp, Homo sapiens
gaactctccagtgccctatagctgcaagagtt

SEQ ID NO: 8651 - DNA, 32 bp, Homo sapiens
actttgaggttagtctgaatcttgaactttaa

SEQ ID NO: 8652 - DNA, 16 bp, Homo sapiens
catttgccacccagga

SEQ ID NO: 8653 - DNA, 32 bp, Homo sapiens
caactctgcagggcttctctccctgccaccac

SEQ ID NO: 8654 - DNA, 32 bp, Homo sapiens
tcctccccaacaaacagtacctgggatggagc

SEQ ID NO: 8655 - DNA, 32 bp, Homo sapiens
accactgcttcctgggttcaagtgattctcat

SEQ ID NO: 8656 - DNA, 32 bp, Homo sapiens
tttctatcaagcaagaatgccacgtactcaga

SEQ ID NO: 8657 - DNA, 32 bp, Homo sapiens
ccaggttcaagcaattctgctgtctcagcttc

SEQ ID NO: 8658 - DNA, 32 bp, Homo sapiens
ggggctcagattgggacagaattcttttgtga

SEQ ID NO: 8659 - DNA, 32 bp, Homo sapiens
acaagaaaaatagtttttacaaacttctagtt

SEQ ID NO: 8660 - DNA, 32 bp, Homo sapiens
ctcttgtcaccccagctggagtgcagtagcac

SEQ ID NO: 8661 - DNA, 32 bp, Homo sapiens
ccctgttgcccaggctggagtgcaatggtgcg

SEQ ID NO: 8662 - DNA, 32 bp, Homo sapiens
gaacccgggcggcggaagttgcagtgagccga

SEQ ID NO: 8663 - DNA, 32 bp, Homo sapiens
tccgtcggcccagactgaagtgcagtggcaca

SEQ ID NO: 8664 - DNA, 32 bp, Homo sapiens
ccatccaggcctgctgttccaaactttttcag

SEQ ID NO: 8665 - DNA, 24 bp, Homo sapiens
tcatgcctataatcccagtgcttt

SEQ ID NO: 8666 - DNA, 28 bp, Homo sapiens
tgttccccaagtgtacttaatcacctta

SEQ ID NO: 8667 - DNA, 32 bp, Homo sapiens
ctcctctcaagtgccagggagcagccacacgt

SEQ ID NO: 8668 - DNA, 32 bp, Homo sapiens
cccagcctgtcaagtcctcttctgcctcagct

SEQ ID NO: 8669 - DNA, 19 bp, Homo sapiens
gcgaggaggcctcttgaag

SEQ ID NO: 8670 - DNA, 31 bp, Homo sapiens
aacaacaacaacaaaacagcagaggaattgt

SEQ ID NO: 8671 - DNA, 21 bp, Homo sapiens
cagggaagctcttagaatccc

SEQ ID NO: 8672 - DNA, 21 bp, Homo sapiens
tggcaggacgactcactgcgg

SEQ ID NO: 8673 - DNA, 32 bp, Homo sapiens
agccccgatgattcgtaacaccacctttcgcc

SEQ ID NO: 8674 - DNA, 32 bp, Homo sapiens
gacctctcaagtagctgggattacaagcacca

SEQ ID NO: 8675 - DNA, 32 bp, Homo sapiens
atcgctgcctcctgggttcaagcaattctcct

SEQ ID NO: 8676 - DNA, 32 bp, Homo sapiens
ctactcgggaggctgaggcaggggaatcactt

SEQ ID NO: 8677 - DNA, 32 bp, Homo sapiens
aaagtgtgtacagggccgggtgcagtggctca

SEQ ID NO: 8678 - DNA, 32 bp, Homo sapiens
cgctctgtcgccaggctggagtgcaatggcgc

SEQ ID NO: 8679 - DNA, 32 bp, Homo sapiens
ttggctgtctggcctctcaggtgtcagggcca

SEQ ID NO: 8680 - DNA, 32 bp, Homo sapiens
aaagctttagaggaggaatgaaaacaaagtga

SEQ ID NO: 8681 - DNA, 32 bp, Homo sapiens
ctactcgggaggctaaggcaggagaatcactt

SEQ ID NO: 8682 - DNA, 32 bp, Homo sapiens
ggatattctgcagcgcttctgtctttttcttg

SEQ ID NO: 8683 - DNA, 32 bp, Homo sapiens
cagcatctttctttccccatctttctattttc

SEQ ID NO: 8684 - DNA, 32 bp, Homo sapiens
gtggccaagcgaggtctcaggtgcaaagcaaa

SEQ ID NO: 8685 - DNA, 32 bp, Homo sapiens
ggagcaagcaaggttagcaactgtgaacagag

SEQ ID NO: 8686 - DNA, 32 bp, Homo sapiens
atgtcttcagaacttagatgtgaaaatctaca

SEQ ID NO: 8687 - DNA, 32 bp, Homo sapiens
gctcggccttaaggagctgaagagtctgggta

SEQ ID NO: 8688 - DNA, 32 bp, Homo sapiens
tactctgttgccaggctggagtgcagtggcgc

SEQ ID NO: 8689 - DNA, 32 bp, Homo sapiens
ctcacactgcccaggctggagcatagtggcaa

SEQ ID NO: 8690 - DNA, 32 bp, Homo sapiens
cgctctgtcaccaggctggagtgcagtggcgc

SEQ ID NO: 8691 - DNA, 32 bp, Homo sapiens
ccacagaggggtagctgggatcatgctagtca

SEQ ID NO: 8692 - DNA, 32 bp, Homo sapiens
ctcacgctgtccacctgccaggtggagtgtat

SEQ ID NO: 8693 - DNA, 32 bp, Homo sapiens
ctctattgcccaggctggagtgcagtggctca

SEQ ID NO: 8694 - DNA, 32 bp, Homo sapiens
ccgggttcaatcaattctcctacctcaacttc

SEQ ID NO: 8695 - DNA, 32 bp, Homo sapiens
ccacacgacagccctcgagaattctttcaagt

SEQ ID NO: 8696 - DNA, 24 bp, Homo sapiens
tcacgcctgtaatcctagcacttt

SEQ ID NO: 8697 - DNA, 32 bp, Homo sapiens
gaacccaggaggcggaggttgccgtgagccaa

SEQ ID NO: 8698 - DNA, 32 bp, Homo sapiens
agggtgaaaggcgagaggttgcacaggacatg

SEQ ID NO: 8699 - DNA, 32 bp, Homo sapiens
actgtcttgcccaggtaagctggggcagagcc

SEQ ID NO: 8700 - DNA, 32 bp, Homo sapiens
aagagcccctaccttgaaaagaaggttggagt

SEQ ID NO: 8701 - DNA, 20 bp, Homo sapiens
ggcagctgacgaggcagctg

SEQ ID NO: 8702 - DNA, 32 bp, Homo sapiens
ctgtgtttggcttccaggaattacatgaacga

SEQ ID NO: 8703 - DNA, 32 bp, Homo sapiens
tggaaatcaagtataatagccacctcaaagaa

SEQ ID NO: 8704 - DNA, 32 bp, Homo sapiens
ctgggctcaagcaatcctcacacctcagcctc

SEQ ID NO: 8705 - DNA, 32 bp, Homo sapiens
gccttcctttattacaaatcagtattaaaact

SEQ ID NO: 8706 - DNA, 32 bp, Homo sapiens
tcttgttgcctaggctggagtgcaatggcgag

SEQ ID NO: 8707 - DNA, 32 bp, Homo sapiens
gtcacttgcccaggtgcggtggctcacacctg

SEQ ID NO: 8708 - DNA, 32 bp, Homo sapiens
aagtgcaagaattggttgctggtgctacatgg

SEQ ID NO: 8709 - DNA, 32 bp, Homo sapiens
ctgacaagtctgtcttctcttcttggtttcat

SEQ ID NO: 8710 - DNA, 32 bp, Homo sapiens
aattttacatttcaacccatctggctaaagtt

SEQ ID NO: 8711 - DNA, 32 bp, Homo sapiens
gcaacttcagaccattatgatagagcctgctc

SEQ ID NO: 8712 - DNA, 32 bp, Homo sapiens
gcttcagacttagaggtgaataaattgaggtc

SEQ ID NO: 8713 - DNA, 25 bp, Homo sapiens
cgtcgcccaggctggaatgcagtgg

SEQ ID NO: 8714 - DNA, 32 bp, Homo sapiens
ctctgttgcctgggctggagaacagtggcacc

SEQ ID NO: 8715 - DNA, 32 bp, Homo sapiens
agggctggagaacttagctggtgggaaaggag

SEQ ID NO: 8716 - DNA, 22 bp, Homo sapiens
cccaccccctgcccctcgggca

SEQ ID NO: 8717 - DNA, 32 bp, Homo sapiens
taaacgttgggtctcacgtttgttgccattat

SEQ ID NO: 8718 - DNA, 32 bp, Homo sapiens
cactcttgcccaggctgtagtgctgtggcacg

SEQ ID NO: 8719 - DNA, 32 bp, Homo sapiens
actggatgagatggtatctcactgtggttttt

SEQ ID NO: 8720 - DNA, 32 bp, Homo sapiens
ggtcttgtgttgcttctggtctctccaggctt

SEQ ID NO: 8721 - DNA, 32 bp, Homo sapiens
tcctggcatcctgggaggtctctggctttgtg

SEQ ID NO: 8722 - DNA, 32 bp, Homo sapiens
tcgctggggaggcagagtcctcgcgtggtctc

SEQ ID NO: 8723 - DNA, 32 bp, Homo sapiens
ctactcgggaggctgaggtggaaagatggccc

SEQ ID NO: 8724 - DNA, 32 bp, Homo sapiens
atgcaatttccaggctgtgctgtggacttctt

SEQ ID NO: 8725 - DNA, 32 bp, Homo sapiens
gacctaccacgaagccaccaccaccttcagta

SEQ ID NO: 8726 - DNA, 28 bp, Homo sapiens
ggggtcctcaaggctgcctccttccttt

SEQ ID NO: 8727 - DNA, 28 bp, Homo sapiens
tcctccacagtggctgcctcctcatttg

SEQ ID NO: 8728 - DNA, 23 bp, Homo sapiens
accactactgatgagggacagtt

SEQ ID NO: 8729 - DNA, 24 bp, Homo sapiens
ctgtcactcaggctggaatgcagt

SEQ ID NO: 8730 - DNA, 32 bp, Homo sapiens
tggcctccagctgttcttagtgacacacactg

SEQ ID NO: 8731 - DNA, 32 bp, Homo sapiens
cagtttgcatgggctgagttataccagctaga

SEQ ID NO: 8732 - DNA, 32 bp, Homo sapiens
gatggagagccagccagtggggctgtcagcag

SEQ ID NO: 8733 - DNA, 32 bp, Homo sapiens
ctgctggtgctgctgctcgtcatcctggccag

SEQ ID NO: 8734 - DNA, 19 bp, Homo sapiens
gacaggcacatgccaccac

SEQ ID NO: 8735 - DNA, 32 bp, Homo sapiens
catgtttatcctgaatttttacttaataattt

SEQ ID NO: 8736 - DNA, 32 bp, Homo sapiens
gctctgtcacccaaattggagggcggtgatgt

SEQ ID NO: 8737 - DNA, 32 bp, Homo sapiens
cttagctggtttgggagctttgctttccaagt

SEQ ID NO: 8738 - DNA, 32 bp, Homo sapiens
gcagtgggaggaggagaaggaggaggaggaga

SEQ ID NO: 8739 - DNA, 32 bp, Homo sapiens
ggagggaggcagggaggcagggaggcagggag

SEQ ID NO: 8740 - DNA, 32 bp, Homo sapiens
tctgccatttcagaccttttgctgctacctgc

SEQ ID NO: 8741 - DNA, 32 bp, Homo sapiens
ttaatcatccccagtgtccaggcacagagtag

SEQ ID NO: 8742 - DNA, 22 bp, Homo sapiens
ctgtagcccaggctggagtgca

SEQ ID NO: 8743 - DNA, 32 bp, Homo sapiens
cacgcccatcttctgcctcatagtggtcactc

SEQ ID NO: 8744 - DNA, 32 bp, Homo sapiens
tcactgtcacctaggctggagtgcagtggtaa

SEQ ID NO: 8745 - DNA, 32 bp, Homo sapiens
agagatgcagaactgggcccgtggagcagcag

SEQ ID NO: 8746 - DNA, 32 bp, Homo sapiens
aagagtgcaaggctgctcaggtctccaagcgc

SEQ ID NO: 8747 - DNA, 32 bp, Homo sapiens
gtgcttgagggtggctgggaatgtgatataca

SEQ ID NO: 8748 - DNA, 32 bp, Homo sapiens
gactccctgagtaatgggagttctttcatggc

SEQ ID NO: 8749 - DNA, 32 bp, Homo sapiens
agcctcccaagtagctgggattacaggtgtcc

SEQ ID NO: 8750 - DNA, 32 bp, Homo sapiens
gaagaagaggaagaggaaagaaaaggagtcag

SEQ ID NO: 8751 - DNA, 32 bp, Homo sapiens
gagcccaggaagtggaggctgcagtgacctat

SEQ ID NO: 8752 - DNA, 32 bp, Homo sapiens
cctctgtcaccaggctggagtgcagtggtgcg

SEQ ID NO: 8753 - DNA, 17 bp, Homo sapiens
gccaccactgtttagaa

SEQ ID NO: 8754 - DNA, 25 bp, Homo sapiens
cgtcacccaggctggagtgcagtgg

SEQ ID NO: 8755 - DNA, 32 bp, Homo sapiens
gagaaggcgccaacagcacacagggtcagggt

SEQ ID NO: 8756 - DNA, 32 bp, Homo sapiens
cactctgtcaccaggctggagtgcagtgccgc

SEQ ID NO: 8757 - DNA, 32 bp, Homo sapiens
gctctttcgcccaggccggactgcagtggcag

SEQ ID NO: 8758 - DNA, 21 bp, Homo sapiens
cagggaagctcctgatttccc

SEQ ID NO: 8759 - DNA, 32 bp, Homo sapiens
cagagtaggcctgcttcttcccatgaaagcca

SEQ ID NO: 8760 - DNA, 32 bp, Homo sapiens
ggagctcacagaagacccctggaacccagagc

SEQ ID NO: 8761 - DNA, 32 bp, Homo sapiens
agcctcctgagtagctgggactacaggcaccc

SEQ ID NO: 8762 - DNA, 32 bp, Homo sapiens
catcaaaggagattcgggctgtggaaggctcc

SEQ ID NO: 8763 - DNA, 32 bp, Homo sapiens
gacgaaggggtgcctgagctgtggagagggtg

SEQ ID NO: 8764 - DNA, 32 bp, Homo sapiens
ctaggctcaagcaattctcgtgcctcagcctc

SEQ ID NO: 8765 - DNA, 32 bp, Homo sapiens
tgagcttctgtcatatgcccagtattatgctt

SEQ ID NO: 8766 - DNA, 22 bp, Homo sapiens
tgcatttcaatcagaagcaaag

SEQ ID NO: 8767 - DNA, 32 bp, Homo sapiens
tcactgggagcaatggggttgcagctgaagtc

SEQ ID NO: 8768 - DNA, 32 bp, Homo sapiens
aaattcaattaatttttggtgctgctattgca

SEQ ID NO: 8769 - DNA, 32 bp, Homo sapiens
aatgagcattgcctgaatcagagttagctact

SEQ ID NO: 8770 - DNA, 22 bp, Homo sapiens
tgaagggacccgctcccagctc

SEQ ID NO: 8771 - DNA, 32 bp, Homo sapiens
cctggttatgcagcttctcttgtcttcttcat

SEQ ID NO: 8772 - DNA, 32 bp, Homo sapiens
gaatcctggaggcagaggttgcagtgagctga

SEQ ID NO: 8773 - DNA, 24 bp, Homo sapiens
tggcaaaatcatggctcactgcag

SEQ ID NO: 8774 - DNA, 29 bp, Homo sapiens
gggaatgtgctgccccacatgtccaggct

SEQ ID NO: 8775 - DNA, 32 bp, Homo sapiens
agcagtcatccctgccaccagccagagcacag

SEQ ID NO: 8776 - DNA, 32 bp, Homo sapiens
gactggagatttggagatttgtggaaaagtga

SEQ ID NO: 8777 - DNA, 21 bp, Homo sapiens
tcacgcctgtaatccagcact

SEQ ID NO: 8778 - DNA, 28 bp, Homo sapiens
aagcctttaagtgctgcttctgtcagtc

SEQ ID NO: 8779 - DNA, 32 bp, Homo sapiens
gaacccgggaggcggagcttgcagtgagcctt

SEQ ID NO: 8780 - DNA, 18 bp, Homo sapiens
gcttccttccacccagaa

SEQ ID NO: 8781 - DNA, 32 bp, Homo sapiens
ttaccctctgcagcttgtcctcccttccgtct

SEQ ID NO: 8782 - DNA, 32 bp, Homo sapiens
gtgcatggcctgtgctgccttctgcctggctc

SEQ ID NO: 8783 - DNA, 32 bp, Homo sapiens
gctctctcacccaggctggagtagagtgacaa

SEQ ID NO: 8784 - DNA, 32 bp, Homo sapiens
ccagttagcacaaaggaaaatatttcaataaa

SEQ ID NO: 8785 - DNA, 32 bp, Homo sapiens
ttgagacggggtttcgctcttgttgtccaggc

SEQ ID NO: 8786 - DNA, 32 bp, Homo sapiens
tcttgtcacccaggctggagtgcagtggcgcc

SEQ ID NO: 8787 - DNA, 32 bp, Homo sapiens
gccccttgcccagggccagtgccatggggaag

SEQ ID NO: 8788 - DNA, 32 bp, Homo sapiens
agctccacctcctgggttcaagcgattctctt

SEQ ID NO: 8789 - DNA, 32 bp, Homo sapiens
gaacttgggaggcagaggtttcagtgagccga

SEQ ID NO: 8790 - DNA, 32 bp, Homo sapiens
gaacgtgggaggcagaggttgcagtgagccga

SEQ ID NO: 8791 - DNA, 32 bp, Homo sapiens
gaacccgggaggcagaggttgcagtgaggtga

SEQ ID NO: 8792 - DNA, 32 bp, Homo sapiens
aatcatcatccctcatcacccacagtcgcccg

SEQ ID NO: 8793 - DNA, 22 bp, Homo sapiens
gtcgcccaggctggaggttaat

SEQ ID NO: 8794 - DNA, 25 bp, Homo sapiens
cgtcgcccaggctggagtgcagtgg

SEQ ID NO: 8795 - DNA, 32 bp, Homo sapiens
gagtggttgcccaggcctagtttcagtggcag

SEQ ID NO: 8796 - DNA, 32 bp, Homo sapiens
ctgttgttgcccaggctggagtgcaatagcac

SEQ ID NO: 8797 - DNA, 32 bp, Homo sapiens
atcaatgcagaacagctgtggagactctaacc

SEQ ID NO: 8798 - DNA, 32 bp, Homo sapiens
tccagcaggtcctcctgctcccagaggtgacc

SEQ ID NO: 8799 - DNA, 23 bp, Homo sapiens
gatgagggggctccctctgtgga

SEQ ID NO: 8800 - DNA, 32 bp, Homo sapiens
tggccaggcagaggtctgtggagtggagaggc

SEQ ID NO: 8801 - DNA, 32 bp, Homo sapiens
ggcctcctagagtgctgggattacaggtgtga

SEQ ID NO: 8802 - DNA, 32 bp, Homo sapiens
gctgagctgcccaggcttcacggagcggtgtt

SEQ ID NO: 8803 - DNA, 32 bp, Homo sapiens
actctgttgcccaggctggagtgcctcttcat

SEQ ID NO: 8804 - DNA, 22 bp, Homo sapiens
caggaaaaaggttggagcagtg

SEQ ID NO: 8805 - DNA, 32 bp, Homo sapiens
agctctctgcaagtgagagaattctttgggaa

SEQ ID NO: 8806 - DNA, 32 bp, Homo sapiens
gcgtcctgagtagctggggattacaggcgccc

SEQ ID NO: 8807 - DNA, 32 bp, Homo sapiens
acctccacctcccaggttcaagcagttctctg

SEQ ID NO: 8808 - DNA, 32 bp, Homo sapiens
agcacaccctgaatcacccctactggctgacc

SEQ ID NO: 8809 - DNA, 32 bp, Homo sapiens
ttgccactaactgaattcttcaaatactcaca

SEQ ID NO: 8810 - DNA, 32 bp, Homo sapiens
ctgaccaccttgcactattggactttggaagg

SEQ ID NO: 8811 - DNA, 32 bp, Homo sapiens
ttgggatctaccttgggtcttacttgagttcc

SEQ ID NO: 8812 - DNA, 22 bp, Homo sapiens
tcatgcctgtaatcccaacatt

SEQ ID NO: 8813 - DNA, 32 bp, Homo sapiens
atataaaaattggcgaaaagaagccatacgcc

SEQ ID NO: 8814 - DNA, 32 bp, Homo sapiens
gggacggtgctgctgtccacggttacagccca

SEQ ID NO: 8815 - DNA, 20 bp, Homo sapiens
ggcaaatgctgcaaacttcc

SEQ ID NO: 8816 - DNA, 32 bp, Homo sapiens
aggcacgaccctcagatctcagtctagtgaag

SEQ ID NO: 8817 - DNA, 23 bp, Homo sapiens
tggcgcaatctcggctcactgca

SEQ ID NO: 8818 - DNA, 23 bp, Homo sapiens
tggcacaatctcagctcactgca

SEQ ID NO: 8819 - DNA, 23 bp, Homo sapiens
tggtgcaatcttggctcactgca

SEQ ID NO: 8820 - DNA, 32 bp, Homo sapiens
gctcgtcacccaggctggagtgcaattgtgca

SEQ ID NO: 8821 - DNA, 32 bp, Homo sapiens
ccaagaaatgttctatggaagtttacgtttta

SEQ ID NO: 8822 - DNA, 32 bp, Homo sapiens
tatcctgggtcttggcttttcccccatttgtt

SEQ ID NO: 8823 - DNA, 32 bp, Homo sapiens
gcacacaactgcactgaagccttgttcctctc

SEQ ID NO: 8824 - DNA, 28 bp, Homo sapiens
tgcaatactgagtgtgcctcattatctt

SEQ ID NO: 8825 - DNA, 32 bp, Homo sapiens
acccttcctagagcggaggaaccgggtcgtgc

SEQ ID NO: 8826 - DNA, 32 bp, Homo sapiens
tcttgttgcccaggctggagggcaatggtgca

SEQ ID NO: 8827 - DNA, 32 bp, Homo sapiens
tggtccctctgtgcttctctctttctcctccc

SEQ ID NO: 8828 - DNA, 32 bp, Homo sapiens
gcgcactgcagttaatgaattctgccttcaac

SEQ ID NO: 8829 - DNA, 32 bp, Homo sapiens
aagtagaggatgccgaggagaaaacagcaggc

SEQ ID NO: 8830 - DNA, 32 bp, Homo sapiens
ttgagatggagttttgctctcgttgccaaggc

SEQ ID NO: 8831 - DNA, 32 bp, Homo sapiens
gtttgagcctgagacactctttgaggtaaaaa

SEQ ID NO: 8832 - DNA, 32 bp, Homo sapiens
aaaaacagcctatgatagtttgaatccccctc

SEQ ID NO: 8833 - DNA, 32 bp, Homo sapiens
tcttccattttgcacagggagtgcaggaggtg

SEQ ID NO: 8834 - DNA, 32 bp, Homo sapiens
gctctgttgcctgggctggagaacagtggcac

SEQ ID NO: 8835 - DNA, 32 bp, Homo sapiens
tctgtgaagcaacttagctgatgtggaggaat

SEQ ID NO: 8836 - DNA, 32 bp, Homo sapiens
gtgattcacagtgtgaatcttggtgtctacgt

SEQ ID NO: 8837 - DNA, 32 bp, Homo sapiens
agccttccgagtagctgggattacaggcgccc

SEQ ID NO: 8838 - DNA, 32 bp, Homo sapiens
ggcctcccaaagtgctgggattaccggcatga

SEQ ID NO: 8839 - DNA, 32 bp, Homo sapiens
tggagcgggaggcgttgccgtggggcctcgag

SEQ ID NO: 8840 - DNA, 32 bp, Homo sapiens
aggcaggagaatcagaggttgcagtgaaccga

SEQ ID NO: 8841 - DNA, 32 bp, Homo sapiens
ttttaccgcccaggctggagtgcagtgccatg

SEQ ID NO: 8842 - DNA, 32 bp, Homo sapiens
ccatgagacctcagagcttcagatcgaggcct

SEQ ID NO: 8843 - DNA, 15 bp, Homo sapiens
ccccccttccaggtg

SEQ ID NO: 8844 - DNA, 32 bp, Homo sapiens
aagtaaaagaaaaagaaaagaaaataactccc

SEQ ID NO: 8845 - DNA, 24 bp, Homo sapiens
tgacgtggtcatagctcactgcag

SEQ ID NO: 8846 - DNA, 19 bp, Homo sapiens
gccatcactgtcacaagaa

SEQ ID NO: 8847 - DNA, 32 bp, Homo sapiens
tcagtagcctgagtgttatactagagatctaa

SEQ ID NO: 8848 - DNA, 32 bp, Homo sapiens
tgaggcaaggagattggttcactatggagaag

SEQ ID NO: 8849 - DNA, 32 bp, Homo sapiens
tgaccgttgcccacctggaggtgtgcatgcca

SEQ ID NO: 8850 - DNA, 32 bp, Homo sapiens
cagtctccagttctccagtgttcacaggtgag

SEQ ID NO: 8851 - DNA, 32 bp, Homo sapiens
taaggaaggaagtcaaggctgcagtgagctat

SEQ ID NO: 8852 - DNA, 32 bp, Homo sapiens
tcttattgcccaggcttgagtgcaatgacctg

SEQ ID NO: 8853 - DNA, 32 bp, Homo sapiens
agcctcctgagtagctgggactacagtttcgt

SEQ ID NO: 8854 - DNA, 32 bp, Homo sapiens
tccacttctgcagcaagcttcttcctggacat

SEQ ID NO: 8855 - DNA, 32 bp, Homo sapiens
gaaccgaggaggcagagcttgcagtgagccaa

SEQ ID NO: 8856 - DNA, 32 bp, Homo sapiens
gaggccaggagttagagactgcagtgagctat

SEQ ID NO: 8857 - DNA, 32 bp, Homo sapiens
gctctgtcgcccaggttggagtgcagtggcac

SEQ ID NO: 8858 - DNA, 32 bp, Homo sapiens
gctctgtcgcccaggctggagtgcagtggcat

SEQ ID NO: 8859 - DNA, 32 bp, Homo sapiens
tcgctttcaacttcgtcacaggaaaaaggagc

SEQ ID NO: 8860 - DNA, 32 bp, Homo sapiens
tagaaactccattaatcatctgattttccgaa

SEQ ID NO: 8861 - DNA, 32 bp, Homo sapiens
gctctgttgcccaggctggagtgcagtggcac

SEQ ID NO: 8862 - DNA, 32 bp, Homo sapiens
actctgtcacccaggctggagtgcagtggcat

SEQ ID NO: 8863 - DNA, 32 bp, Homo sapiens
tggtttgaaatcaagtggttggaacactgttt

SEQ ID NO: 8864 - DNA, 32 bp, Homo sapiens
cttttataataagttgaaaatttcatataatt

SEQ ID NO: 8865 - DNA, 32 bp, Homo sapiens
gaacccgggaggtggagcttgcagtgagctgg

SEQ ID NO: 8866 - DNA, 32 bp, Homo sapiens
ctgacttcaggtgatccacccacctcggcctt

SEQ ID NO: 8867 - DNA, 32 bp, Homo sapiens
tggatcctagccttatcctctgatctccatgg

SEQ ID NO: 8868 - DNA, 32 bp, Homo sapiens
gctccattgcccaggctggattacagtggcgc

SEQ ID NO: 8869 - DNA, 32 bp, Homo sapiens
cactatttgcccagaagcttggggcagaggtc

SEQ ID NO: 8870 - DNA, 32 bp, Homo sapiens
agcagctgaaggaggagtttgtggaaaattta

SEQ ID NO: 8871 - DNA, 32 bp, Homo sapiens
actggccacagagatatcctggaagacacgtg

SEQ ID NO: 8872 - DNA, 32 bp, Homo sapiens
acctccacttcctgggttcaagcgattctcct

SEQ ID NO: 8873 - DNA, 32 bp, Homo sapiens
gaacctgggaggcggaggttgcagtcagccaa

SEQ ID NO: 8874 - DNA, 32 bp, Homo sapiens
agtttgcccagtactggagaaaatgaactggg

SEQ ID NO: 8875 - DNA, 32 bp, Homo sapiens
cctgtgagccttgactgggattcatgatgtgg

SEQ ID NO: 8876 - DNA, 32 bp, Homo sapiens
gagatgggaggaggagaaaaagcggtacgatg

SEQ ID NO: 8877 - DNA, 32 bp, Homo sapiens
gaacccaggaggcggagcttgcagtgagctga

SEQ ID NO: 8878 - DNA, 32 bp, Homo sapiens
gaacctgggaggcggagcttgcagtgagccaa

SEQ ID NO: 8879 - DNA, 32 bp, Homo sapiens
cttggccatcttcttccttcgtcgtctctcct

SEQ ID NO: 8880 - DNA, 19 bp, Homo sapiens
ggcggccatccagaagctg

SEQ ID NO: 8881 - DNA, 20 bp, Homo sapiens
cctttcatcctatgcagctt

SEQ ID NO: 8882 - DNA, 32 bp, Homo sapiens
actctgtcgcccaggctggagtgcaatactgc

SEQ ID NO: 8883 - DNA, 32 bp, Homo sapiens
ggccagcacccctggctggagtgggttaaagg

SEQ ID NO: 8884 - DNA, 32 bp, Homo sapiens
acccgcacagaacttggtctctggaatccagc

SEQ ID NO: 8885 - DNA, 23 bp, Homo sapiens
tgttgcccaggctagagtgcagt

SEQ ID NO: 8886 - DNA, 32 bp, Homo sapiens
aggttgggctcaggctgggtgctctgccatgg

SEQ ID NO: 8887 - DNA, 32 bp, Homo sapiens
agattttgcccagaggagtaaatggaggtggg

SEQ ID NO: 8888 - DNA, 32 bp, Homo sapiens
cctctgtcaccaaggctggagtgcattggtgc

SEQ ID NO: 8889 - DNA, 32 bp, Homo sapiens
gagtgcaggtgggcataggtgcagtgagtgca

SEQ ID NO: 8890 - DNA, 32 bp, Homo sapiens
ggcggcgggaggcggaggaggcggcggcggcg

SEQ ID NO: 8891 - DNA, 32 bp, Homo sapiens
tggggcaggaggcagaggcaggagaccaagat

SEQ ID NO: 8892 - DNA, 28 bp, Homo sapiens
catctctcccttcctgcctcatttcatc

SEQ ID NO: 8893 - DNA, 28 bp, Homo sapiens
atgagtgaaagggttgcctcatcaagca

SEQ ID NO: 8894 - DNA, 32 bp, Homo sapiens
tggacacaagagccactgcacaacagccaagg

SEQ ID NO: 8895 - DNA, 20 bp, Homo sapiens
tgcgggtgaagggatgggga

SEQ ID NO: 8896 - DNA, 32 bp, Homo sapiens
tctcttcgtcttctcctcttccttgtcccctc

SEQ ID NO: 8897 - DNA, 24 bp, Homo sapiens
tcacgcttacagtcccagcacttt

SEQ ID NO: 8898 - DNA, 32 bp, Homo sapiens
ggttctgcatgacctagccactgctgggggtt

SEQ ID NO: 8899 - DNA, 32 bp, Homo sapiens
tttagacaagagtctcgctttgttgcccaggc

SEQ ID NO: 8900 - DNA, 23 bp, Homo sapiens
acagacattagccatcacgcctg

SEQ ID NO: 8901 - DNA, 32 bp, Homo sapiens
gcccacagcccctggtcatctgatatcagagc

SEQ ID NO: 8902 - DNA, 32 bp, Homo sapiens
cacctatcacccaggctggagtggagtggcac

SEQ ID NO: 8903 - DNA, 32 bp, Homo sapiens
ggaaggcgattggcatcgatctctccatccct

SEQ ID NO: 8904 - DNA, 32 bp, Homo sapiens
gcatcctggaggtgaaggttgcagtgagccaa

SEQ ID NO: 8905 - DNA, 19 bp, Homo sapiens
ggccaggctggagtgcagt

SEQ ID NO: 8906 - DNA, 32 bp, Homo sapiens
acttctgccacccaggttcaagcaattctcct

SEQ ID NO: 8907 - DNA, 32 bp, Homo sapiens
catacatttttctcttctcttctcctgacgtc

SEQ ID NO: 8908 - DNA, 21 bp, Homo sapiens
tcacgcctgtaataccagcac

SEQ ID NO: 8909 - DNA, 32 bp, Homo sapiens
caacctgggaggcggaggttgcagtgagctta

SEQ ID NO: 8910 - DNA, 32 bp, Homo sapiens
gatgatgtactctgggtcaagagaccagggat

SEQ ID NO: 8911 - DNA, 32 bp, Homo sapiens
gctggagcctgagtcagggcccagaggctgag

SEQ ID NO: 8912 - DNA, 32 bp, Homo sapiens
tgaaagtatgatttcatttcccagaaaatgta

SEQ ID NO: 8913 - DNA, 32 bp, Homo sapiens
aggatggagcaatggttctcaaacttcagcca

SEQ ID NO: 8914 - DNA, 22 bp, Homo sapiens
tggcacgaacacggctcactgc

SEQ ID NO: 8915 - DNA, 32 bp, Homo sapiens
aaatcttcacctatgatccaggcacagatgtg

SEQ ID NO: 8916 - DNA, 32 bp, Homo sapiens
tgacactctagtgacttcctggtgaggcccag

SEQ ID NO: 8917 - DNA, 32 bp, Homo sapiens
ctgctcgggaggctgaggcaggagaattgttg

SEQ ID NO: 8918 - DNA, 32 bp, Homo sapiens
cggagcgggaggcggtggtagagagagataaa

SEQ ID NO: 8919 - DNA, 32 bp, Homo sapiens
tattaatgggcctgcttcttagcaatattaga

SEQ ID NO: 8920 - DNA, 32 bp, Homo sapiens
accaagtgaagaggaggagaaagagtcaacca

SEQ ID NO: 8921 - DNA, 32 bp, Homo sapiens
gatttcccaagtgcatcctcagaagctctggg

SEQ ID NO: 8922 - DNA, 32 bp, Homo sapiens
gaacccggtaggcggagcttgcagtgagctga

SEQ ID NO: 8923 - DNA, 32 bp, Homo sapiens
ataatgcatcttcttccctccttctactgtac

SEQ ID NO: 8924 - DNA, 22 bp, Homo sapiens
atgcctgtaatcccaacacttt

SEQ ID NO: 8925 - DNA, 32 bp, Homo sapiens
gaaggagaaagaggaggagagagaaaaagggc

SEQ ID NO: 8926 - DNA, 32 bp, Homo sapiens
catctctctgcagtgccctcctcgcctgtgca

SEQ ID NO: 8927 - DNA, 32 bp, Homo sapiens
tccaagtctgcagcctcccattctctaggcct

SEQ ID NO: 8928 - DNA, 32 bp, Homo sapiens
catcagaacgcatccctcatctggactccagc

SEQ ID NO: 8929 - DNA, 18 bp, Homo sapiens
gaaggggcccagaacacc

SEQ ID NO: 8930 - DNA, 22 bp, Homo sapiens
ccatttctccgtcggctcggca

SEQ ID NO: 8931 - DNA, 32 bp, Homo sapiens
tttctcttcttagcttctccattgtctaaatc

SEQ ID NO: 8932 - DNA, 32 bp, Homo sapiens
cctggggtggaagagaaatgagcttggcttgc

SEQ ID NO: 8933 - DNA, 32 bp, Homo sapiens
ttcatggtgctgctcctgctatggttccacag

SEQ ID NO: 8934 - DNA, 32 bp, Homo sapiens
tgttctcatccctggttccttggccacggtgg

SEQ ID NO: 8935 - DNA, 32 bp, Homo sapiens
agggaagagaattggtgctgcagaagtgtacc

SEQ ID NO: 8936 - DNA, 32 bp, Homo sapiens
agcaccgagagccacttcctggagcatgctcc

SEQ ID NO: 8937 - DNA, 32 bp, Homo sapiens
caagtgagtctcggctggagtgcagtggtgca

SEQ ID NO: 8938 - DNA, 32 bp, Homo sapiens
gaatccggattgctgaatcttccctgttgcct

SEQ ID NO: 8939 - DNA, 32 bp, Homo sapiens
cctctgtcgccaaagttggagtgcagtggcgc

SEQ ID NO: 8940 - DNA, 32 bp, Homo sapiens
cgccatcctagagtgaggctctgtccaataca

SEQ ID NO: 8941 - DNA, 32 bp, Homo sapiens
ttggagaggaggcagccagcagtggcagtcca

SEQ ID NO: 8942 - DNA, 32 bp, Homo sapiens
tcttgttgcccaggctggagtgtgatgggctc

SEQ ID NO: 8943 - DNA, 17 bp, Homo sapiens
gcccctgccattgcagg

SEQ ID NO: 8944 - DNA, 25 bp, Homo sapiens
tcatgcctgtaatctccagcacttt

SEQ ID NO: 8945 - DNA, 32 bp, Homo sapiens
gtcttgaactcctggcctcaagcaatccgcct

SEQ ID NO: 8946 - DNA, 23 bp, Homo sapiens
ggtctccagggggtccctgtgca

SEQ ID NO: 8947 - DNA, 32 bp, Homo sapiens
gagctgcttcagtccatctcccagaggcattt

SEQ ID NO: 8948 - DNA, 32 bp, Homo sapiens
actccacatcttctgccccagtgtgtccccac

SEQ ID NO: 8949 - DNA, 32 bp, Homo sapiens
cagcctgaagagaccagtgagctcactgtgac

SEQ ID NO: 8950 - DNA, 32 bp, Homo sapiens
gctctgccacccaggctggagtgcagtggtgc

SEQ ID NO: 8951 - DNA, 32 bp, Homo sapiens
gctctgtccctcaggctggagtgcagtagcgt

SEQ ID NO: 8952 - DNA, 32 bp, Homo sapiens
aaggaggggtctaggagctctgtcccttgtaa

SEQ ID NO: 8953 - DNA, 32 bp, Homo sapiens
aacctccctagtagctgggattacaggtgcac

SEQ ID NO: 8954 - DNA, 32 bp, Homo sapiens
acctctacctccagggttcaagcaattctcct

SEQ ID NO: 8955 - DNA, 32 bp, Homo sapiens
agaggaagaagaggagatggctgaaacatata

SEQ ID NO: 8956 - DNA, 32 bp, Homo sapiens
cacttcgggaggccaaggtgagaggataactt

SEQ ID NO: 8957 - DNA, 32 bp, Homo sapiens
ctcgcagtatcctagaatctttgtgctctcgc

SEQ ID NO: 8958 - DNA, 32 bp, Homo sapiens
tgttcctccacacatgtaaaggcacagtggct

SEQ ID NO: 8959 - DNA, 32 bp, Homo sapiens
gcagcagcctgagtgttctcactaggggtcac

SEQ ID NO: 8960 - DNA, 32 bp, Homo sapiens
gcagcctcatcatttcccatctggacctggta

SEQ ID NO: 8961 - DNA, 32 bp, Homo sapiens
agggagggaatagaggaatgtgttcgggttaa

SEQ ID NO: 8962 - DNA, 32 bp, Homo sapiens
gggtgtggacccagacgtggagtggagtgatt

SEQ ID NO: 8963 - DNA, 32 bp, Homo sapiens
ggcagtggtgctggcctcacagccctggccat

SEQ ID NO: 8964 - DNA, 32 bp, Homo sapiens
aattaattcatgaataaatgcaccttatatgt

SEQ ID NO: 8965 - DNA, 32 bp, Homo sapiens
gtcagttgattttcaacaatggtgctaaaaca

SEQ ID NO: 8966 - DNA, 18 bp, Homo sapiens
tgtggggaggggaggaga

SEQ ID NO: 8967 - DNA, 32 bp, Homo sapiens
agggaagggagtaggaaaagaaaagcattttt

SEQ ID NO: 8968 - DNA, 32 bp, Homo sapiens
tttgaagcttcaaacttagtgctgctgcagac

SEQ ID NO: 8969 - DNA, 32 bp, Homo sapiens
tgttaccaacaacagcagacttctacatgtac

SEQ ID NO: 8970 - DNA, 32 bp, Homo sapiens
ttaccagtggactacaggattacttgagagtt

SEQ ID NO: 8971 - DNA, 32 bp, Homo sapiens
acccaacaccttccatgacacttccttgcttt

SEQ ID NO: 8972 - DNA, 32 bp, Homo sapiens
ctttgtcacccaggctggagtacagtggcgtg

SEQ ID NO: 8973 - DNA, 32 bp, Homo sapiens
ctcctgctcaccacctgcctctaatctgagct

SEQ ID NO: 8974 - DNA, 32 bp, Homo sapiens
atgaaggttaagctggcggtgctgctggtgac

SEQ ID NO: 8975 - DNA, 32 bp, Homo sapiens
ctctgtcacctaggctggagtgcagtggcatg

SEQ ID NO: 8976 - DNA, 32 bp, Homo sapiens
tcttgttgcccaggctggagtgaaatggtgcg

SEQ ID NO: 8977 - DNA, 24 bp, Homo sapiens
tcatgcctgtaagcccagcacttt

SEQ ID NO: 8978 - DNA, 32 bp, Homo sapiens
ccttttacttcctgaattcaattcagtttgat

SEQ ID NO: 8979 - DNA, 32 bp, Homo sapiens
gaggccgggaggcggctgcaaggggcggggaa

SEQ ID NO: 8980 - DNA, 32 bp, Homo sapiens
aagagattcctttcttcttgtgacaaaacatc

SEQ ID NO: 8981 - DNA, 32 bp, Homo sapiens
tgagctccagaaggagctttctgggccagctt

SEQ ID NO: 8982 - DNA, 24 bp, Homo sapiens
tcattcctgtaatcccagcacttt

SEQ ID NO: 8983 - DNA, 32 bp, Homo sapiens
gttatggtgatggatggatgtggatttggaag

SEQ ID NO: 8984 - DNA, 32 bp, Homo sapiens
aacagaagaccaggagaaaaagtcaaaaagaa

SEQ ID NO: 8985 - DNA, 32 bp, Homo sapiens
tgccatgtccatcctccacaggcagaacagga

SEQ ID NO: 8986 - DNA, 32 bp, Homo sapiens
caatccgcctcccaggttcaagcgattctccc

SEQ ID NO: 8987 - DNA, 32 bp, Homo sapiens
cagttcgggaggcagagttaggtggatcaatt

SEQ ID NO: 8988 - DNA, 32 bp, Homo sapiens
tgctgcgggaggcggcggcggtaggaagccgg

SEQ ID NO: 8989 - DNA, 32 bp, Homo sapiens
ggctcatgcctgtaatcccagcactttcggag

SEQ ID NO: 8990 - DNA, 32 bp, Homo sapiens
gacacatctcctgagggatcccagaaagaacc

SEQ ID NO: 8991 - DNA, 32 bp, Homo sapiens
tgtcaaggggtaggagaaagagacgcaaacac

SEQ ID NO: 8992 - DNA, 32 bp, Homo sapiens
aaaagaacattagagtatagatcatgtgaaat

SEQ ID NO: 8993 - DNA, 32 bp, Homo sapiens
catcaccaatgtctgtcatgctgagcaagagg

SEQ ID NO: 8994 - DNA, 32 bp, Homo sapiens
ccttgccaggacctgctcccagctccacgacg

SEQ ID NO: 8995 - DNA, 18 bp, Homo sapiens
gccatcactgccagtcag

SEQ ID NO: 8996 - DNA, 32 bp, Homo sapiens
gctctgtcgaccaggctggagtgcaggggcac

SEQ ID NO: 8997 - DNA, 32 bp, Homo sapiens
tggggcccaggggaggcctgagcttggattta

SEQ ID NO: 8998 - DNA, 32 bp, Homo sapiens
gctctgtcacccaggctggagtgccatggcat

SEQ ID NO: 8999 - DNA, 32 bp, Homo sapiens
tttattgtggaccccatggaatgtgattaaat

SEQ ID NO: 9000 - DNA, 32 bp, Homo sapiens
gctagctatcattaccagttagaattaacatt

SEQ ID NO: 9001 - DNA, 28 bp, Homo sapiens
agcccaccaagaggtgcctcattagaac

SEQ ID NO: 9002 - DNA, 32 bp, Homo sapiens
ctgctcgggaggctgaggcaggggaatcgctt

SEQ ID NO: 9003 - DNA, 32 bp, Homo sapiens
actctgttgctaggctggagtgcagtggcaca

SEQ ID NO: 9004 - DNA, 32 bp, Homo sapiens
ctgttgctgtgcctgctcacacctgctcctgc

SEQ ID NO: 9005 - DNA, 32 bp, Homo sapiens
cgtgtgtttccttccaggcacagtgatcattc

SEQ ID NO: 9006 - DNA, 32 bp, Homo sapiens
agagaaccctcagcttctctctgcctctggag

SEQ ID NO: 9007 - DNA, 32 bp, Homo sapiens
aatagctttgtttttgctatgctaatgtctag

SEQ ID NO: 9008 - DNA, 32 bp, Homo sapiens
ttgagacagagtttcgctcttgttgcccaagc

SEQ ID NO: 9009 - DNA, 32 bp, Homo sapiens
ttgagacggagtttcactcttattgcccaggc

SEQ ID NO: 9010 - DNA, 32 bp, Homo sapiens
gccaggattccttttccatctcctctctttct

SEQ ID NO: 9011 - DNA, 32 bp, Homo sapiens
actctgccgcccaaactggagtgcagtggcac

SEQ ID NO: 9012 - DNA, 32 bp, Homo sapiens
actctgtgtcccaggctggagtgcagtggcac

SEQ ID NO: 9013 - DNA, 32 bp, Homo sapiens
attgaaaagacaggagaaaagcaaacagaaac

SEQ ID NO: 9014 - DNA, 32 bp, Homo sapiens
gaacccagaaggcagaggttgcatgatgcaat

SEQ ID NO: 9015 - DNA, 32 bp, Homo sapiens
ggaggtcaacatctatctaatttaaaagctat

SEQ ID NO: 9016 - DNA, 32 bp, Homo sapiens
aaaatctttgtcgtctgcatctggaaccaaaa

SEQ ID NO: 9017 - DNA, 23 bp, Homo sapiens
agacccacttgggccttcatgcc

SEQ ID NO: 9018 - DNA, 26 bp, Homo sapiens
aatgaggaatgtatatgttttgtggg

SEQ ID NO: 9019 - DNA, 32 bp, Homo sapiens
tgggtggcctatgatggatgggggctctgtgg

SEQ ID NO: 9020 - DNA, 32 bp, Homo sapiens
tttgaccacttgtgactggagttcagtggccc

SEQ ID NO: 9021 - DNA, 32 bp, Homo sapiens
atgacagcctctccctacaagagaccagtagc

SEQ ID NO: 9022 - DNA, 32 bp, Homo sapiens
gcctcgacctcccaggctcaagcaattctcct

SEQ ID NO: 9023 - DNA, 32 bp, Homo sapiens
agcctcctgagtagctaggattacaggtgtgt

SEQ ID NO: 9024 - DNA, 32 bp, Homo sapiens
ggcctcccgagtagctgggattacaggtgtgc

SEQ ID NO: 9025 - DNA, 32 bp, Homo sapiens
agcctcccaagtagctgggattacaggtgtgc

SEQ ID NO: 9026 - DNA, 32 bp, Homo sapiens
caaaaaggaacctctttcaggagctataaaag

SEQ ID NO: 9027 - DNA, 32 bp, Homo sapiens
ggagagagtttggacatctcactcaaaagtac

SEQ ID NO: 9028 - DNA, 32 bp, Homo sapiens
gaacctgggaggtagaggttgcactgagccga

SEQ ID NO: 9029 - DNA, 32 bp, Homo sapiens
cctctgtggggtgaggaatgggtcttgtgaaa

SEQ ID NO: 9030 - DNA, 32 bp, Homo sapiens
acctatatctcccttgaaaatactttcaggct

SEQ ID NO: 9031 - DNA, 32 bp, Homo sapiens
ttgagatggagttttgctctgtcacccaggct

SEQ ID NO: 9032 - DNA, 32 bp, Homo sapiens
tcttgttgcccaggctggagtacaatggcgcg

SEQ ID NO: 9033 - DNA, 32 bp, Homo sapiens
tcttgttgcccgggctggagtgcaatggtgag

SEQ ID NO: 9034 - DNA, 32 bp, Homo sapiens
tggaaactcagtaattctcccaccttcacatt

SEQ ID NO: 9035 - DNA, 32 bp, Homo sapiens
caacctgttacagtgaggagatcacagtgtgt

SEQ ID NO: 9036 - DNA, 32 bp, Homo sapiens
tcttgttgcccaggctggagtgcaatggcacg

SEQ ID NO: 9037 - DNA, 32 bp, Homo sapiens
ctctgttgcccagggtggagtgcagcggtgcg

SEQ ID NO: 9038 - DNA, 32 bp, Homo sapiens
tcccctcatcttctccactactatccacatga

SEQ ID NO: 9039 - DNA, 17 bp, Homo sapiens
gcccttgtactcaggta

SEQ ID NO: 9040 - DNA, 32 bp, Homo sapiens
tacccaaatttccaagacacaaacatgaccta

SEQ ID NO: 9041 - DNA, 32 bp, Homo sapiens
gcctcagactcctgggttcaagcaatcctcct

SEQ ID NO: 9042 - DNA, 32 bp, Homo sapiens
acctccaactccctggttcaagcgattctcct

SEQ ID NO: 9043 - DNA, 32 bp, Homo sapiens
tgccggaggcctggcagctccgctaactccat

SEQ ID NO: 9044 - DNA, 32 bp, Homo sapiens
ataccgtggggtgacttcctggtcaccaaggc

SEQ ID NO: 9045 - DNA, 32 bp, Homo sapiens
acctccgcctcccaggttcaagtaattctcct

SEQ ID NO: 9046 - DNA, 32 bp, Homo sapiens
tctgttcttaagatgaggagagtatctgtgtt

SEQ ID NO: 9047 - DNA, 32 bp, Homo sapiens
gagcctggtaggctgaggctgcagtgagccaa

SEQ ID NO: 9048 - DNA, 32 bp, Homo sapiens
ctggcctcatgtgatctgcccacctcagcctc

SEQ ID NO: 9049 - DNA, 32 bp, Homo sapiens
gaaggaagaagagggaagaatccgaccacttt

SEQ ID NO: 9050 - DNA, 32 bp, Homo sapiens
gagagcgactctgtgtcccaggcacagctgtg

SEQ ID NO: 9051 - DNA, 32 bp, Homo sapiens
tgcggtgaagaagatggtagaaaacagtctgg

SEQ ID NO: 9052 - DNA, 32 bp, Homo sapiens
tgcagacggggagtagctttgtggaaactgat

SEQ ID NO: 9053 - DNA, 32 bp, Homo sapiens
tgtgactcgggagacggagtggaacacccggc

SEQ ID NO: 9054 - DNA, 32 bp, Homo sapiens
ctactacgtcactacctggaagcaattgcctt

SEQ ID NO: 9055 - DNA, 32 bp, Homo sapiens
agggtggaaggtaagaggttggtgtggagttg

SEQ ID NO: 9056 - DNA, 32 bp, Homo sapiens
gaaccaggaaggcagaggttgcactgagctga

SEQ ID NO: 9057 - DNA, 32 bp, Homo sapiens
gttagtggctgcctcatatagcacttttgaag

SEQ ID NO: 9058 - DNA, 32 bp, Homo sapiens
actcttgtgcccaggctggagtgcaatagctc

SEQ ID NO: 9059 - DNA, 32 bp, Homo sapiens
ctcagagttgtggctgttatctcttcaggaat

SEQ ID NO: 9060 - DNA, 24 bp, Homo sapiens
ttgttgtccagtctggagtgcaat

SEQ ID NO: 9061 - DNA, 32 bp, Homo sapiens
ggaaggaaagagaacgggccaagactgggact

SEQ ID NO: 9062 - DNA, 32 bp, Homo sapiens
accacagaggggaccagggcactgtgagccct

SEQ ID NO: 9063 - DNA, 32 bp, Homo sapiens
tctcagtcgcccaggctggagtgcagcagcac

SEQ ID NO: 9064 - DNA, 32 bp, Homo sapiens
gattttgaatttaggctgggtgcagtggctca

SEQ ID NO: 9065 - DNA, 32 bp, Homo sapiens
ggaaaaggaagtgcccttatccacgaccaagc

SEQ ID NO: 9066 - DNA, 32 bp, Homo sapiens
agctaaaggaggctgaggttgcagtgagctga

SEQ ID NO: 9067 - DNA, 32 bp, Homo sapiens
tgaaccaggaggtggacgttgcagtgatccca

SEQ ID NO: 9068 - DNA, 32 bp, Homo sapiens
aggaaagaaactgaagaaagaagataatagac

SEQ ID NO: 9069 - DNA, 28 bp, Homo sapiens
actggtcaagtgaatgcctcatgtttct

SEQ ID NO: 9070 - DNA, 28 bp, Homo sapiens
tggtgcccaagtgagtcacatccaggta

SEQ ID NO: 9071 - DNA, 32 bp, Homo sapiens
ttggtttaataatcagaaaatattcaatacag

SEQ ID NO: 9072 - DNA, 32 bp, Homo sapiens
tcggatgctagcacttgacactgtgagcgcac

SEQ ID NO: 9073 - DNA, 19 bp, Homo sapiens
cccccactgccactcagaa

SEQ ID NO: 9074 - DNA, 32 bp, Homo sapiens
ttgtgaccagggtctggatgagcttgaatttg

SEQ ID NO: 9075 - DNA, 32 bp, Homo sapiens
tcgtccaggttagagtgcaatggcttgatctc

SEQ ID NO: 9076 - DNA, 32 bp, Homo sapiens
gagagccttgttctgtcacctaggctggaatg

SEQ ID NO: 9077 - DNA, 32 bp, Homo sapiens
tcttgttgcccaggctggagtgaagtggcgtg

SEQ ID NO: 9078 - DNA, 32 bp, Homo sapiens
ggctgtgacgtcactggatgtgtcctgatcta

SEQ ID NO: 9079 - DNA, 32 bp, Homo sapiens
tctctgtcgcccaggctggcgtgaagtggcgc

SEQ ID NO: 9080 - DNA, 32 bp, Homo sapiens
gtgaaggtcatgcgatgcctggaacaccccaa

SEQ ID NO: 9081 - DNA, 32 bp, Homo sapiens
tgttggcagggaggcctcctggaaccagtcag

SEQ ID NO: 9082 - DNA, 32 bp, Homo sapiens
tagtgtgctaagctgagcagtgcagtgtgaac

SEQ ID NO: 9083 - DNA, 24 bp, Homo sapiens
ctgttgcccaagctggagtgcagt

SEQ ID NO: 9084 - DNA, 32 bp, Homo sapiens
ccctgaggagccggaccgatgtggaaactgct

SEQ ID NO: 9085 - DNA, 32 bp, Homo sapiens
ctacccgggaggcgaagagaagcacagaagaa

SEQ ID NO: 9086 - DNA, 32 bp, Homo sapiens
aaacctgggaggcggagcttgcagtgagccga

SEQ ID NO: 9087 - DNA, 32 bp, Homo sapiens
cactgtcacccaggctggagtgcagtggcatg

SEQ ID NO: 9088 - DNA, 32 bp, Homo sapiens
gagagcgatttctgggatggaagccatctgcc

SEQ ID NO: 9089 - DNA, 32 bp, Homo sapiens
aatgagggaagacgagaaagagagtgggagag

SEQ ID NO: 9090 - DNA, 28 bp, Homo sapiens
tgtgatggaagagctgcctcatcacgta

SEQ ID NO: 9091 - DNA, 32 bp, Homo sapiens
ctctgtcgctcaggctggagtgcagtgatgca

SEQ ID NO: 9092 - DNA, 32 bp, Homo sapiens
tttccagtaaaaacatgaccagcttacaaaaa

SEQ ID NO: 9093 - DNA, 32 bp, Homo sapiens
catgggctctaagctgctcttctgtctgtctg

SEQ ID NO: 9094 - DNA, 32 bp, Homo sapiens
acttagagaagaggaagagaataggaaaacca

SEQ ID NO: 9095 - DNA, 32 bp, Homo sapiens
cctttgaacacatcttcttgctgaacattatg

SEQ ID NO: 9096 - DNA, 32 bp, Homo sapiens
cccctgtttattcttgaacagagggcaaagag

SEQ ID NO: 9097 - DNA, 32 bp, Homo sapiens
actctgtcacccaggctggagtacagtggcat

SEQ ID NO: 9098 - DNA, 32 bp, Homo sapiens
actctgtcacccaggctggagtgcagtggcgt

SEQ ID NO: 9099 - DNA, 32 bp, Homo sapiens
acctgggagttagaggttgcagtgagctgaga

SEQ ID NO: 9100 - DNA, 32 bp, Homo sapiens
gctctgtcgcccaggctggagtgcagtggcgt

SEQ ID NO: 9101 - DNA, 32 bp, Homo sapiens
gctctgtcgcccaggttggagtgcagtggcgc

SEQ ID NO: 9102 - DNA, 32 bp, Homo sapiens
gctctgttgcccaggctggagtgcagtggcgc

SEQ ID NO: 9103 - DNA, 32 bp, Homo sapiens
cttctccctgtcggtgaaggatcatgttcagg

SEQ ID NO: 9104 - DNA, 32 bp, Homo sapiens
ggccatcaacatcgcagatgagctgccccgct

SEQ ID NO: 9105 - DNA, 32 bp, Homo sapiens
cccaacgtgattctccccagctctgagtctct

SEQ ID NO: 9106 - DNA, 20 bp, Homo sapiens
tgtgccaatcccagcactcc

SEQ ID NO: 9107 - DNA, 24 bp, Homo sapiens
tcgggcctgtaatcccagcacttt

SEQ ID NO: 9108 - DNA, 32 bp, Homo sapiens
ttaaaaaggcaaaacctgaaccaccttctgca

SEQ ID NO: 9109 - DNA, 32 bp, Homo sapiens
gacgctactgcagcttttgccttggttcttcc

SEQ ID NO: 9110 - DNA, 32 bp, Homo sapiens
ccctctgcaggagcttctcctgccgccagcca

SEQ ID NO: 9111 - DNA, 23 bp, Homo sapiens
gtttgtcagaagaccctgaagta

SEQ ID NO: 9112 - DNA, 22 bp, Homo sapiens
acacacatgcagtgagaggcct

SEQ ID NO: 9113 - DNA, 32 bp, Homo sapiens
gggctgtaggagcttgtttagcccacctgcat

SEQ ID NO: 9114 - DNA, 32 bp, Homo sapiens
acggcaatgcctttgaacttggcagctctggc

SEQ ID NO: 9115 - DNA, 32 bp, Homo sapiens
accacctttgtgctgctctaaccttcagagtt

SEQ ID NO: 9116 - DNA, 32 bp, Homo sapiens
tccacagaagccctctcacaggcatggccacc

SEQ ID NO: 9117 - DNA, 32 bp, Homo sapiens
tccagaggctctagaggagaatctttccttgc

SEQ ID NO: 9118 - DNA, 32 bp, Homo sapiens
attccttggagccactgggattcatggctttg

SEQ ID NO: 9119 - DNA, 32 bp, Homo sapiens
agcctcctgaatagctgggattacaggtgcac

SEQ ID NO: 9120 - DNA, 32 bp, Homo sapiens
gaacctgggagggggaggttgccgtgagctga

SEQ ID NO: 9121 - DNA, 32 bp, Homo sapiens
ttttgtttacaagaataattagcaatactgag

SEQ ID NO: 9122 - DNA, 32 bp, Homo sapiens
ggcttatgcctgtaatcccagcactttgcagg

SEQ ID NO: 9123 - DNA, 32 bp, Homo sapiens
atactatattttctccccaataccaccaacga

SEQ ID NO: 9124 - DNA, 31 bp, Homo sapiens
gcccacacactgcatagcaggagggaagcat

SEQ ID NO: 9125 - DNA, 32 bp, Homo sapiens
gagcctaggaagtcgaggctgcagtgagctga

SEQ ID NO: 9126 - DNA, 32 bp, Homo sapiens
tgcaggtcagtatcctgggacttggaagctgg

SEQ ID NO: 9127 - DNA, 32 bp, Homo sapiens
aagaactctgcagcttcctgccttctgggtca

SEQ ID NO: 9128 - DNA, 32 bp, Homo sapiens
ttactctcaggggcttctctgtcatctgactt

SEQ ID NO: 9129 - DNA, 32 bp, Homo sapiens
gctctgccgcccaggcgggagtgcagtggcag

SEQ ID NO: 9130 - DNA, 32 bp, Homo sapiens
acatcctggagtttggctctagtcacttctgg

SEQ ID NO: 9131 - DNA, 32 bp, Homo sapiens
acctcccttgttagcatctcccagagaacctg

SEQ ID NO: 9132 - DNA, 32 bp, Homo sapiens
taaataatggattgctttttagcaatagagct

SEQ ID NO: 9133 - DNA, 32 bp, Homo sapiens
ccccgccccctgggctggagggctgtgtgtgg

SEQ ID NO: 9134 - DNA, 24 bp, Homo sapiens
tcacgcctgtaatcccaacacttt

SEQ ID NO: 9135 - DNA, 32 bp, Homo sapiens
tcccatctcaaggtccttaacagcatgtggaa

SEQ ID NO: 9136 - DNA, 32 bp, Homo sapiens
aaattgccaagtgcctatgcaaaccagcttta

SEQ ID NO: 9137 - DNA, 32 bp, Homo sapiens
taaatgtttgccagactgggtgcagaatttat

SEQ ID NO: 9138 - DNA, 30 bp, Homo sapiens
gctgaccaacatggtgaaatgaaaccccat

SEQ ID NO: 9139 - DNA, 32 bp, Homo sapiens
taaagctggtttttcttgattacttgagaagc

SEQ ID NO: 9140 - DNA, 32 bp, Homo sapiens
aacagagaagtaacaggaaacacctaacgcaa

SEQ ID NO: 9141 - DNA, 32 bp, Homo sapiens
gccgaaaccgatgtgtctatggtgctgcacct

SEQ ID NO: 9142 - DNA, 32 bp, Homo sapiens
tcgggttccagcaattctcctgcctcagcctc

SEQ ID NO: 9143 - DNA, 32 bp, Homo sapiens
agcctctcgagtagctgggagtacagatgcac

SEQ ID NO: 9144 - DNA, 32 bp, Homo sapiens
ctctgttacccagattggagtgcagtggcgcg

SEQ ID NO: 9145 - DNA, 32 bp, Homo sapiens
ctctgtcgcccaggctggagtgcagtggcaca

SEQ ID NO: 9146 - DNA, 32 bp, Homo sapiens
tctgacactgaatttggatgcaccttgtttta

SEQ ID NO: 9147 - DNA, 32 bp, Homo sapiens
ctctgtcacccaggctggagtgcagtggcacg

SEQ ID NO: 9148 - DNA, 32 bp, Homo sapiens
ctctgtcacccagactggagtgcagtggcgcg

SEQ ID NO: 9149 - DNA, 32 bp, Homo sapiens
ctctgtcacccaggctagagtgcaatggcacg

SEQ ID NO: 9150 - DNA, 32 bp, Homo sapiens
gcctgaagacgaagagaaagagcaaggttatt

SEQ ID NO: 9151 - DNA, 32 bp, Homo sapiens
caacctgggaggtagaggttgcagtgagccga

SEQ ID NO: 9152 - DNA, 32 bp, Homo sapiens
ctctgtcacccaggctggagtgtagtggcatg

SEQ ID NO: 9153 - DNA, 24 bp, Homo sapiens
ctgttgcccaagctggagtacagt

SEQ ID NO: 9154 - DNA, 32 bp, Homo sapiens
ataccacatcttctcacttatagatggtagct

SEQ ID NO: 9155 - DNA, 32 bp, Homo sapiens
ttctaggagagaggtgaaagaaacctggcaaa

SEQ ID NO: 9156 - DNA, 32 bp, Homo sapiens
tctccaccttctccccgccaggcacaggagcc

SEQ ID NO: 9157 - DNA, 18 bp, Homo sapiens
gagaggcgagcaccggga

SEQ ID NO: 9158 - DNA, 32 bp, Homo sapiens
ctctgttgcccaggctggagtgcggtggcatg

SEQ ID NO: 9159 - DNA, 32 bp, Homo sapiens
actgtgtcatgcaggctggagtgcagtggcat

SEQ ID NO: 9160 - DNA, 32 bp, Homo sapiens
tgcaggatgcccagggctcggaagcagtaagg

SEQ ID NO: 9161 - DNA, 32 bp, Homo sapiens
actttgttgcccaggctggagtgcggtggcgt

SEQ ID NO: 9162 - DNA, 32 bp, Homo sapiens
actacttttgacaacgcctcaaacttttctaa

SEQ ID NO: 9163 - DNA, 32 bp, Homo sapiens
gctttgtcagccaggctggagtgcagtgacac

SEQ ID NO: 9164 - DNA, 32 bp, Homo sapiens
gctttgttgcccagactggagtgcagtggcat

SEQ ID NO: 9165 - DNA, 32 bp, Homo sapiens
gggctcacctccctggttcaagcgattgtccc

SEQ ID NO: 9166 - DNA, 32 bp, Homo sapiens
tactctctggtaagacttgaatgtgattattt

SEQ ID NO: 9167 - DNA, 32 bp, Homo sapiens
ggaaacccaagaggctgagaattcttttgtct

SEQ ID NO: 9168 - DNA, 32 bp, Homo sapiens
ctactcagcaatgccttcctggaccacaaccc

SEQ ID NO: 9169 - DNA, 32 bp, Homo sapiens
ctttgtcgcccaggctggagtgcaatggcgtg

SEQ ID NO: 9170 - DNA, 32 bp, Homo sapiens
ctctgtcgcccagactggagtgcagtagcgcc

SEQ ID NO: 9171 - DNA, 32 bp, Homo sapiens
aaactttacatgcctgatggcaccttactcca

SEQ ID NO: 9172 - DNA, 32 bp, Homo sapiens
tctgtgcatcttcttgtccattcatctgccca

SEQ ID NO: 9173 - DNA, 32 bp, Homo sapiens
gagtctgggaggtggaggctgcagtgagccgt

SEQ ID NO: 9174 - DNA, 32 bp, Homo sapiens
ttcacagggaggcaaagctgacatgaaccttt

SEQ ID NO: 9175 - DNA, 32 bp, Homo sapiens
gtgttaagcccaaagtgtgtgtttctggttgg

SEQ ID NO: 9176 - DNA, 32 bp, Homo sapiens
atcccagccctctctgtcttaattagcacaaa

SEQ ID NO: 9177 - DNA, 32 bp, Homo sapiens
gtcccccttcttgcttctctctccttctttcc

SEQ ID NO: 9178 - DNA, 32 bp, Homo sapiens
tcaaatagcacacaggaatcaaactttggtaa

SEQ ID NO: 9179 - DNA, 32 bp, Homo sapiens
ggtcctgatacttgtttcttttcacgttttcc

SEQ ID NO: 9180 - DNA, 32 bp, Homo sapiens
tagagatggagtttcactatgttggccaggct

SEQ ID NO: 9181 - DNA, 32 bp, Homo sapiens
gagtgtgggccaggctgagtgcataggtgaca

SEQ ID NO: 9182 - DNA, 32 bp, Homo sapiens
ctgggctcaagtgatccttccacctcagcctc

SEQ ID NO: 9183 - DNA, 32 bp, Homo sapiens
ttctttgcctgagatccttcctgaggagcgtc

SEQ ID NO: 9184 - DNA, 32 bp, Homo sapiens
aaccaatgctctgcctcagggtgcaaatgcca

SEQ ID NO: 9185 - DNA, 32 bp, Homo sapiens
acatagtgtaggtcagcgtgcttagcctcctg

SEQ ID NO: 9186 - DNA, 32 bp, Homo sapiens
tgcttctgcccaggcctggtctgggggcagag

SEQ ID NO: 9187 - DNA, 32 bp, Homo sapiens
gacactggaaatgttcaactgtagttttatta

SEQ ID NO: 9188 - DNA, 32 bp, Homo sapiens
tcactgtcacccaggctggagtgcagtggcat

SEQ ID NO: 9189 - DNA, 32 bp, Homo sapiens
ctgtgtggcccaggctggagtgcagtggcgca

SEQ ID NO: 9190 - DNA, 32 bp, Homo sapiens
ctctgtcgtccaggctggagtgcagtggcgcc

SEQ ID NO: 9191 - DNA, 32 bp, Homo sapiens
ctagcctcaagggatccgcccacctcagtctc

SEQ ID NO: 9192 - DNA, 32 bp, Homo sapiens
cctccttagaagatacctaacaacagcactgt

SEQ ID NO: 9193 - DNA, 32 bp, Homo sapiens
gcttgtcacccaggctggagtgcaatggcatg

SEQ ID NO: 9194 - DNA, 32 bp, Homo sapiens
ttctgttgcccaggagggagtgcagtggtgca

SEQ ID NO: 9195 - DNA, 32 bp, Homo sapiens
tgcctgggtgcagcttctctagctggccttgc

SEQ ID NO: 9196 - DNA, 17 bp, Homo sapiens
gcccctgccttcccagg

SEQ ID NO: 9197 - DNA, 32 bp, Homo sapiens
ggtggaggggtgtgggaaagaaaccagccata

SEQ ID NO: 9198 - DNA, 32 bp, Homo sapiens
tctctgtcagccaggctggagtgtggtggcac

SEQ ID NO: 9199 - DNA, 32 bp, Homo sapiens
atctccccttcctcttcttgatggacatttat

SEQ ID NO: 9200 - DNA, 32 bp, Homo sapiens
tgagattggctttcactgcactgagccacaat

SEQ ID NO: 9201 - DNA, 32 bp, Homo sapiens
ctctggtactcaggctggagtgcggtggtgtg

SEQ ID NO: 9202 - DNA, 32 bp, Homo sapiens
agcacatgcccaggatcgtgtgtgtggggctt

SEQ ID NO: 9203 - DNA, 32 bp, Homo sapiens
gagcccaggaggtggaggttgcagtgagcgga

SEQ ID NO: 9204 - DNA, 32 bp, Homo sapiens
gagcttgggaaatcaaggttgcagtgagctat

SEQ ID NO: 9205 - DNA, 32 bp, Homo sapiens
gaacccaggagacggtggttgcagtgagcgaa

SEQ ID NO: 9206 - DNA, 21 bp, Homo sapiens
ctggagaatagcgctgagttg

SEQ ID NO: 9207 - DNA, 28 bp, Homo sapiens
aaggaaccaagtgcatttttatctgtga

SEQ ID NO: 9208 - DNA, 32 bp, Homo sapiens
agttatcagggaaagaggttgatgtgaactca

SEQ ID NO: 9209 - DNA, 32 bp, Homo sapiens
gcctgtgatacttgggctgtgatcctctagag

SEQ ID NO: 9210 - DNA, 19 bp, Homo sapiens
acaggcgtgagccaccctg

SEQ ID NO: 9211 - DNA, 32 bp, Homo sapiens
ccctgttgcccaggctggagtgcaatggcgcg

SEQ ID NO: 9212 - DNA, 32 bp, Homo sapiens
cctgctggccccaggacttctgatctcagtcc

SEQ ID NO: 9213 - DNA, 32 bp, Homo sapiens
cgctctgtcgccaggctggagtgcagtggcgt

SEQ ID NO: 9214 - DNA, 32 bp, Homo sapiens
agtttcccagttcttcctgcgtgcgggcgaga

SEQ ID NO: 9215 - DNA, 32 bp, Homo sapiens
agcaggttttgcggaacccccatgacgcaggc

SEQ ID NO: 9216 - DNA, 32 bp, Homo sapiens
ggaggaggagccgtgaccctgtggaaggtgcg

SEQ ID NO: 9217 - DNA, 32 bp, Homo sapiens
gaattcaagaattgaggtttgggaacttctgc

SEQ ID NO: 9218 - DNA, 32 bp, Homo sapiens
ggcactccaagtgcatcctccactggcaacag

SEQ ID NO: 9219 - DNA, 32 bp, Homo sapiens
actctgtcaccagactggagtgcagtggcgcc

SEQ ID NO: 9220 - DNA, 32 bp, Homo sapiens
aaagaaggaacatttcctatggtgctgtctca

SEQ ID NO: 9221 - DNA, 24 bp, Homo sapiens
tggcatgatcatagctcactgcag

SEQ ID NO: 9222 - DNA, 32 bp, Homo sapiens
agtttacatccctcattcacagtgtaaagcag

SEQ ID NO: 9223 - DNA, 32 bp, Homo sapiens
aataaacctaaccttttaacagggtctaacat

SEQ ID NO: 9224 - DNA, 32 bp, Homo sapiens
ctgagaaacttgacaagtatctctccatttta

SEQ ID NO: 9225 - DNA, 20 bp, Homo sapiens
cagggaggcccttcccaccc

SEQ ID NO: 9226 - DNA, 32 bp, Homo sapiens
gatggaatttcactcttgttgcctagctggag

SEQ ID NO: 9227 - DNA, 32 bp, Homo sapiens
cttgaagatagaggggccatgtggaaatcaag

SEQ ID NO: 9228 - DNA, 32 bp, Homo sapiens
aaggtggaaagaggagaacgtagcaatctggc

SEQ ID NO: 9229 - DNA, 32 bp, Homo sapiens
ccaggttcaagcattcttctgcctcagcctcc

SEQ ID NO: 9230 - DNA, 25 bp, Homo sapiens
ctgtcaacgcagactggagtgcagt

SEQ ID NO: 9231 - DNA, 22 bp, Homo sapiens
gggcaacaaaccagggcagctg

SEQ ID NO: 9232 - DNA, 32 bp, Homo sapiens
ctgaatgtgtggtcagcatctgtacaaatgca

SEQ ID NO: 9233 - DNA, 24 bp, Homo sapiens
tcacacctgttaatcccagcactt

SEQ ID NO: 9234 - DNA, 32 bp, Homo sapiens
ggggccgcaggggctggccactgtgggctcgg

SEQ ID NO: 9235 - DNA, 32 bp, Homo sapiens
ctggctccagaaggagctttccaggatagctt

SEQ ID NO: 9236 - DNA, 32 bp, Homo sapiens
cactagcatcttctctaccttcaagaaccagg

SEQ ID NO: 9237 - DNA, 32 bp, Homo sapiens
tcggggctgaccaggctgggggtccagtgaaa

SEQ ID NO: 9238 - DNA, 32 bp, Homo sapiens
gctctgtcacccaggccggagtgcagtggtgc

SEQ ID NO: 9239 - DNA, 32 bp, Homo sapiens
gctacgtgacccaggctggagtgtagtagcta

SEQ ID NO: 9240 - DNA, 32 bp, Homo sapiens
acctccacctcctgggttcaggcgattctcct

SEQ ID NO: 9241 - DNA, 30 bp, Homo sapiens
ccgaagccaacaactagctggtccctgtcg

SEQ ID NO: 9242 - DNA, 32 bp, Homo sapiens
cctaatacaaatatttctgataagactacaaa

SEQ ID NO: 9243 - DNA, 32 bp, Homo sapiens
ctgcctggacccagatgctcccagaatcaata

SEQ ID NO: 9244 - DNA, 32 bp, Homo sapiens
tgctggtgaagctcctggaagtgatggaagga

SEQ ID NO: 9245 - DNA, 32 bp, Homo sapiens
ccctgttggccaggctggagtgcagtaagtgg

SEQ ID NO: 9246 - DNA, 32 bp, Homo sapiens
aagcccacgtgaggctggagtgatgtggccac

SEQ ID NO: 9247 - DNA, 32 bp, Homo sapiens
ttttctgcctgagattctttaaggagatagac

SEQ ID NO: 9248 - DNA, 32 bp, Homo sapiens
tccctgtcctcctcctggattgttgaggaaaa

SEQ ID NO: 9249 - DNA, 32 bp, Homo sapiens
gtctcccccttcctgcatcaccaccttggttt

SEQ ID NO: 9250 - DNA, 32 bp, Homo sapiens
gccttccacttccttccatctcatttctaaac

SEQ ID NO: 9251 - DNA, 32 bp, Homo sapiens
acaaagcccttcaggctggagtatagtggcat

SEQ ID NO: 9252 - DNA, 32 bp, Homo sapiens
actctgtcacccaggttcgagttcagtggtgc

SEQ ID NO: 9253 - DNA, 32 bp, Homo sapiens
agcctcacgagtagctgggactacaggcgcct

SEQ ID NO: 9254 - DNA, 32 bp, Homo sapiens
gaggtgaagaattttgcaggtgggagatttgg

SEQ ID NO: 9255 - DNA, 32 bp, Homo sapiens
tgttgtctcccaggctggagtgcagtggcgtg

SEQ ID NO: 9256 - DNA, 32 bp, Homo sapiens
aaaaatttgaacgaggctagtgcaatgttttg

SEQ ID NO: 9257 - DNA, 32 bp, Homo sapiens
ctgctctgcccaggaggtggcgtccagcagtc

SEQ ID NO: 9258 - DNA, 24 bp, Homo sapiens
tcacgcctgtggtcccagcacttt

SEQ ID NO: 9259 - DNA, 32 bp, Homo sapiens
ctattcccaagtggtcttcaagcaccagtgta

SEQ ID NO: 9260 - DNA, 32 bp, Homo sapiens
gaacccaggaggtagaagttgcagtgagccga

SEQ ID NO: 9261 - DNA, 32 bp, Homo sapiens
ttcgtctccctctcttttacccagagacagca

SEQ ID NO: 9262 - DNA, 32 bp, Homo sapiens
acgtctatttccctcagacacagggatccttg

SEQ ID NO: 9263 - DNA, 32 bp, Homo sapiens
ccagcctggccaacatgacccatctttactaa

SEQ ID NO: 9264 - DNA, 32 bp, Homo sapiens
ctctgtagaccaggctggagcgcagtggcagg

SEQ ID NO: 9265 - DNA, 32 bp, Homo sapiens
acgcagatagaagatccaagaaaacaatggag

SEQ ID NO: 9266 - DNA, 19 bp, Homo sapiens
cagggaagcctggacaccc

SEQ ID NO: 9267 - DNA, 32 bp, Homo sapiens
agcctcccaagtagctgggattacaggcgcac

SEQ ID NO: 9268 - DNA, 32 bp, Homo sapiens
gctctgtggccacccggctcccatggcgggag

SEQ ID NO: 9269 - DNA, 32 bp, Homo sapiens
ctatttgcttcctggtattggagcagttcagt

SEQ ID NO: 9270 - DNA, 32 bp, Homo sapiens
gaacctgggaggtggtggttgcagtgagctga

SEQ ID NO: 9271 - DNA, 32 bp, Homo sapiens
tcataaggtagtccactgaagtgcagtcatca

SEQ ID NO: 9272 - DNA, 32 bp, Homo sapiens
accccttcaagcagttgtttcccattcccaac

SEQ ID NO: 9273 - DNA, 32 bp, Homo sapiens
acatgtgagaagtaagaaagaaactaaagacc

SEQ ID NO: 9274 - DNA, 32 bp, Homo sapiens
cggccctcaagtgcccgggccggccttcgtgc

SEQ ID NO: 9275 - DNA, 32 bp, Homo sapiens
gaacctgggaggtggaggttgcagtgagctgt

SEQ ID NO: 9276 - DNA, 32 bp, Homo sapiens
cattgtaaacaacagacttacgttaaacttca

SEQ ID NO: 9277 - DNA, 28 bp, Homo sapiens
gaaatgctgctgctgccatttcaactgt

SEQ ID NO: 9278 - DNA, 32 bp, Homo sapiens
gtgtggcagctccgatagcaggcacagggaat

SEQ ID NO: 9279 - DNA, 32 bp, Homo sapiens
ctgagcctatctggctgggatggtggaattaa

SEQ ID NO: 9280 - DNA, 32 bp, Homo sapiens
agccttctgagtagctgggaccacaggcgtgc

SEQ ID NO: 9281 - DNA, 32 bp, Homo sapiens
gaacccgggaggcagcagttgcagtgagctga

SEQ ID NO: 9282 - DNA, 32 bp, Homo sapiens
ggaatacacatcctgaagatctcgtgactata

SEQ ID NO: 9283 - DNA, 32 bp, Homo sapiens
cagagcctggagctgagctcttggtgactggt

SEQ ID NO: 9284 - DNA, 32 bp, Homo sapiens
gaaacacctaaccttgacagaatcatcaccag

SEQ ID NO: 9285 - DNA, 32 bp, Homo sapiens
gataccaataaaacatgtcactagtttccaaa

SEQ ID NO: 9286 - DNA, 32 bp, Homo sapiens
tgacagggcaggaagagaagaaaacggaggag

SEQ ID NO: 9287 - DNA, 32 bp, Homo sapiens
ctggcagtgtgggatggatgaatgaagtggaa

SEQ ID NO: 9288 - DNA, 32 bp, Homo sapiens
caacaccttgatgttggatgtgaactgtgagg

SEQ ID NO: 9289 - DNA, 23 bp, Homo sapiens
tggcgtgatctcggctcattgca

SEQ ID NO: 9290 - DNA, 32 bp, Homo sapiens
aactctgcagcaggctggtgctgtgtagtggc

SEQ ID NO: 9291 - DNA, 32 bp, Homo sapiens
agcctcccaaagtactgggattataggcatga

SEQ ID NO: 9292 - DNA, 32 bp, Homo sapiens
acctctgcttcccaggttcaagcgattctcct

SEQ ID NO: 9293 - DNA, 32 bp, Homo sapiens
tcgggcctgacccgtccacacagggccgtgtc

SEQ ID NO: 9294 - DNA, 32 bp, Homo sapiens
agtggaagaagagggagagatggagcaaagtg

SEQ ID NO: 9295 - DNA, 32 bp, Homo sapiens
gctcatcgtctagtgaggaaggcatgtgtgaa

SEQ ID NO: 9296 - DNA, 25 bp, Homo sapiens
ctgggcaacatggcgaaaacccatc

SEQ ID NO: 9297 - DNA, 32 bp, Homo sapiens
ttctgggagccttttgacagctggtccctgcc

SEQ ID NO: 9298 - DNA, 21 bp, Homo sapiens
gctcgatctcggctcactgca

SEQ ID NO: 9299 - DNA, 32 bp, Homo sapiens
gtctgttgcccaggttggagtgcagtggcggg

SEQ ID NO: 9300 - DNA, 32 bp, Homo sapiens
cgctctgttgccaggctggagtgcactggggc

SEQ ID NO: 9301 - DNA, 32 bp, Homo sapiens
tgccccggggttctgtccaccggggaggaaag

SEQ ID NO: 9302 - DNA, 32 bp, Homo sapiens
gcgtgcagggctgtttttctggaacatccttt

SEQ ID NO: 9303 - DNA, 32 bp, Homo sapiens
acctgggcctcccgggttcaagcaattctgtc

SEQ ID NO: 9304 - DNA, 32 bp, Homo sapiens
ctggcctcaagcaattctcccacttcagcctc

SEQ ID NO: 9305 - DNA, 32 bp, Homo sapiens
ggcacatgcctgtaatcctagcactttgggag

SEQ ID NO: 9306 - DNA, 32 bp, Homo sapiens
agcctcctgagtacctgggattacaggtgcac

SEQ ID NO: 9307 - DNA, 32 bp, Homo sapiens
ctggcctcaagcaatcctcccacctcagcctc

SEQ ID NO: 9308 - DNA, 32 bp, Homo sapiens
ttgtgctcaagtgattctcccatctcagcctc

SEQ ID NO: 9309 - DNA, 32 bp, Homo sapiens
ctggtttcaagcaatcctcctacctcagcttc

SEQ ID NO: 9310 - DNA, 32 bp, Homo sapiens
atctccgcctcccaggctcaagcaattctcct

SEQ ID NO: 9311 - DNA, 32 bp, Homo sapiens
gagcgcgggaggcggcggcggcgcggagccca

SEQ ID NO: 9312 - DNA, 32 bp, Homo sapiens
ctctattgcccagtctggagtgcagtggcatg

SEQ ID NO: 9313 - DNA, 32 bp, Homo sapiens
aaagacattcctgggtgacaggcacagtgcag

SEQ ID NO: 9314 - DNA, 21 bp, Homo sapiens
catctgcaaacgctttgccaa

SEQ ID NO: 9315 - DNA, 24 bp, Homo sapiens
tcatgcctataatcccagcacttt

SEQ ID NO: 9316 - DNA, 32 bp, Homo sapiens
gatgtgtaacaagttgatttggaacactggac

SEQ ID NO: 9317 - DNA, 32 bp, Homo sapiens
gcctctaactcctgggctcaagcaatccaagt

SEQ ID NO: 9318 - DNA, 32 bp, Homo sapiens
tctaccaaaaatacaggaaattatctgggcat

SEQ ID NO: 9319 - DNA, 32 bp, Homo sapiens
agtgtgtggtagccaacaaactacctagaaac

SEQ ID NO: 9320 - DNA, 32 bp, Homo sapiens
acctaaggaagcgcgatgctggaacacatccc

SEQ ID NO: 9321 - DNA, 32 bp, Homo sapiens
gcacggcggcggcagaggcggcggcggccggg

SEQ ID NO: 9322 - DNA, 32 bp, Homo sapiens
gaatccagaaggcggaggttgcagtgagctga

SEQ ID NO: 9323 - DNA, 32 bp, Homo sapiens
acacagcctgcacccacccccacatctgggcc

SEQ ID NO: 9324 - DNA, 19 bp, Homo sapiens
cctgtaaccccagcacttt

SEQ ID NO: 9325 - DNA, 19 bp, Homo sapiens
cctgtaatcccagcatttt

SEQ ID NO: 9326 - DNA, 32 bp, Homo sapiens
tccaacagaaggaggaagtgaaaacaaactat

SEQ ID NO: 9327 - DNA, 32 bp, Homo sapiens
ctctgtggcccaggccggcagtggctgcctct

SEQ ID NO: 9328 - DNA, 32 bp, Homo sapiens
gctctgtcgcccaagctgaagtgcagtggtgc

SEQ ID NO: 9329 - DNA, 32 bp, Homo sapiens
gtgaaagcctgagtcccaccagaaggaccttc

SEQ ID NO: 9330 - DNA, 32 bp, Homo sapiens
gagccctggcggcagaggttgcagtgagccaa

SEQ ID NO: 9331 - DNA, 32 bp, Homo sapiens
ctctttcgcccaggctggcgtgcagtggcaca

SEQ ID NO: 9332 - DNA, 32 bp, Homo sapiens
ggcctaccgagtagctgggactacaggcacgc

SEQ ID NO: 9333 - DNA, 32 bp, Homo sapiens
ccggggtcgccggcttctctcctgcctccggt

SEQ ID NO: 9334 - DNA, 32 bp, Homo sapiens
ggcggcctctatgtgctcaggtgcagaccttc

SEQ ID NO: 9335 - DNA, 32 bp, Homo sapiens
gagcatgggaggcagaggttgcagtgagccaa

SEQ ID NO: 9336 - DNA, 32 bp, Homo sapiens
agtggagagccaggggagtgtgggtcagataa

SEQ ID NO: 9337 - DNA, 23 bp, Homo sapiens
aacccacctggagacgcagttca

SEQ ID NO: 9338 - DNA, 18 bp, Homo sapiens
ggcaaatgggattgtccc

SEQ ID NO: 9339 - DNA, 32 bp, Homo sapiens
ccttttcgcccaggctgagtacagtggtgcaa

SEQ ID NO: 9340 - DNA, 32 bp, Homo sapiens
gcctcaaactcctgggttcaagtaaccctccc

SEQ ID NO: 9341 - DNA, 32 bp, Homo sapiens
acctctgcttcctgggttcaggtgattgtcag

SEQ ID NO: 9342 - DNA, 32 bp, Homo sapiens
gatttgtgaatatcatcatctttgccagacaa

SEQ ID NO: 9343 - DNA, 32 bp, Homo sapiens
catctggcaggtgcccttgatgctatagcgcc

SEQ ID NO: 9344 - DNA, 32 bp, Homo sapiens
gaacacaggaggcagaggttgcagcgagctga

SEQ ID NO: 9345 - DNA, 23 bp, Homo sapiens
cagacggcggcatcctccagccc

SEQ ID NO: 9346 - DNA, 32 bp, Homo sapiens
agctgcgtgctgctgcactcaccggcttcttc

SEQ ID NO: 9347 - DNA, 32 bp, Homo sapiens
aagcggccacttctccctccctgagacccgag

SEQ ID NO: 9348 - DNA, 32 bp, Homo sapiens
ctgagggtacgtgccatcatctctccagccca

SEQ ID NO: 9349 - DNA, 32 bp, Homo sapiens
taaatattccttcgagctttgttttcataaaa

SEQ ID NO: 9350 - DNA, 32 bp, Homo sapiens
actgacatgcattattttcactgtgaattcac

SEQ ID NO: 9351 - DNA, 32 bp, Homo sapiens
tgtgtagtgcaaccatctgataaactagtgtg

SEQ ID NO: 9352 - DNA, 32 bp, Homo sapiens
ctatcttgcccaggcttgcaatttatagagct

SEQ ID NO: 9353 - DNA, 32 bp, Homo sapiens
ttcttccagcgatggtctcccactcagagctg

SEQ ID NO: 9354 - DNA, 32 bp, Homo sapiens
tggctcatgcctgtaatccagcactttgggag

SEQ ID NO: 9355 - DNA, 32 bp, Homo sapiens
caaagaccttgtgcccttcccaggagccgcgg

SEQ ID NO: 9356 - DNA, 32 bp, Homo sapiens
tttctggggaggcagagaggcagggactttgg

SEQ ID NO: 9357 - DNA, 32 bp, Homo sapiens
catgcctcctaagagaggagtgcattgcttta

SEQ ID NO: 9358 - DNA, 32 bp, Homo sapiens
ctttttcctttcttcatttttctgcctggaat

SEQ ID NO: 9359 - DNA, 24 bp, Homo sapiens
tcacgccaggaatcccagcacttt

SEQ ID NO: 9360 - DNA, 28 bp, Homo sapiens
cagaaaccaagtgctctagcctcagccc

SEQ ID NO: 9361 - DNA, 32 bp, Homo sapiens
tgagtatccaccatgtgccaggcacagtgctg

SEQ ID NO: 9362 - DNA, 32 bp, Homo sapiens
tcctgcagagcctctttccctctgccacagtt

SEQ ID NO: 9363 - DNA, 32 bp, Homo sapiens
gtgggtgaacctgagctctcccaggagacaac

SEQ ID NO: 9364 - DNA, 32 bp, Homo sapiens
ctcttgttgcccaggctagagtgcaatggcgc

SEQ ID NO: 9365 - DNA, 32 bp, Homo sapiens
ctcttgtcgcccaggctggagtgcagtggcgt

SEQ ID NO: 9366 - DNA, 23 bp, Homo sapiens
tggcgtgatctccactcactgca

SEQ ID NO: 9367 - DNA, 32 bp, Homo sapiens
ctctgttgtccaggctggagtgcagtggcacc

SEQ ID NO: 9368 - DNA, 32 bp, Homo sapiens
tttccaacctccatttcagcctgtctgtctca

SEQ ID NO: 9369 - DNA, 32 bp, Homo sapiens
tagagaaaagagaccatgtttatttgggtagg

SEQ ID NO: 9370 - DNA, 32 bp, Homo sapiens
ccaagttcaagcaattctcctgcctcagcctc

SEQ ID NO: 9371 - DNA, 32 bp, Homo sapiens
ccaggtttaagcaattctcctgcttcaacctc

SEQ ID NO: 9372 - DNA, 32 bp, Homo sapiens
atgcttctctgattccctcttctgcctgcacc

SEQ ID NO: 9373 - DNA, 32 bp, Homo sapiens
ctctgtctcccaggctggagtgcagtggagtg

SEQ ID NO: 9374 - DNA, 32 bp, Homo sapiens
ctatgtcactcaggctggagtgcagtggcaca

SEQ ID NO: 9375 - DNA, 32 bp, Homo sapiens
tgtggatgggaaactgctccagctccaagagg

SEQ ID NO: 9376 - DNA, 32 bp, Homo sapiens
tgaccagcattctcttcttggtaacatctact

SEQ ID NO: 9377 - DNA, 32 bp, Homo sapiens
atccttaaatttttatgacaccctttgtaatc

SEQ ID NO: 9378 - DNA, 32 bp, Homo sapiens
cagtgtgaacaacgtggccaagcttcgacaat

SEQ ID NO: 9379 - DNA, 32 bp, Homo sapiens
cagagtcttgctctgctggagtgcggtggtgc

SEQ ID NO: 9380 - DNA, 32 bp, Homo sapiens
ccagaggggagaggagagagcctggacagcct

SEQ ID NO: 9381 - DNA, 32 bp, Homo sapiens
actcatcaacatcagctaaatatagctgatat

SEQ ID NO: 9382 - DNA, 32 bp, Homo sapiens
actctttcgcccaggctggagtgcattggcat

SEQ ID NO: 9383 - DNA, 32 bp, Homo sapiens
tctaccatgagcaattctcctgcctcagcctc

SEQ ID NO: 9384 - DNA, 32 bp, Homo sapiens
aagcattcaagcaactctgtattttcctcata

SEQ ID NO: 9385 - DNA, 28 bp, Homo sapiens
agtggaccccagggtgcctcataccagc

SEQ ID NO: 9386 - DNA, 32 bp, Homo sapiens
ctgtaaaggaggcaggagtgtcagagtgacgg

SEQ ID NO: 9387 - DNA, 32 bp, Homo sapiens
ccctctgtgccaggccagagtgcagtggtgca

SEQ ID NO: 9388 - DNA, 32 bp, Homo sapiens
ttataggtgccacagggcacagctccatcatt

SEQ ID NO: 9389 - DNA, 32 bp, Homo sapiens
tggaatgctgtgtcctctcttctgtctcctgc

SEQ ID NO: 9390 - DNA, 32 bp, Homo sapiens
caccacctcattgttctcatctggaactgaaa

SEQ ID NO: 9391 - DNA, 32 bp, Homo sapiens
tggcaggagttggaagtgtgtgatctgtgggc

SEQ ID NO: 9392 - DNA, 32 bp, Homo sapiens
cagatggagaaacaggctctgagatttcacag

SEQ ID NO: 9393 - DNA, 32 bp, Homo sapiens
gatccagagctgctgctgctcactgccagtcc

SEQ ID NO: 9394 - DNA, 32 bp, Homo sapiens
gctaagaactcatggccactgtggaaatcttg

SEQ ID NO: 9395 - DNA, 32 bp, Homo sapiens
tcccgcaccccaggctggggcagcgagggcgt

SEQ ID NO: 9396 - DNA, 32 bp, Homo sapiens
ctgggttcaagcagttctcctgcctcagcctc

SEQ ID NO: 9397 - DNA, 32 bp, Homo sapiens
ctgggttcaagcaattctcctacctcagcctc

SEQ ID NO: 9398 - DNA, 32 bp, Homo sapiens
aaacccaggaggcagaggttgcagtgagtgaa

SEQ ID NO: 9399 - DNA, 32 bp, Homo sapiens
gcactccggaggtagaggttgtggtgagccga

SEQ ID NO: 9400 - DNA, 32 bp, Homo sapiens
cctccttgcccaggcaggaggctggggtgctg

SEQ ID NO: 9401 - DNA, 18 bp, Homo sapiens
tgtgggaacgagagggga

SEQ ID NO: 9402 - DNA, 32 bp, Homo sapiens
gaggaggaacagaaaagaaaagaaaagaaaaa

SEQ ID NO: 9403 - DNA, 32 bp, Homo sapiens
gagcccaggaagcagaggttgcagtgagcctc

SEQ ID NO: 9404 - DNA, 23 bp, Homo sapiens
tggcttgatctcggctcattgca

SEQ ID NO: 9405 - DNA, 32 bp, Homo sapiens
gtatctttctcattacaataggcacagagaag

SEQ ID NO: 9406 - DNA, 32 bp, Homo sapiens
gtcattcctaacctaaccttagagtccctccc

SEQ ID NO: 9407 - DNA, 32 bp, Homo sapiens
attgtcccctccattctaggatttcatcgtca

SEQ ID NO: 9408 - DNA, 32 bp, Homo sapiens
atatgtgatcagctttcaaagcatttacaagt

SEQ ID NO: 9409 - DNA, 32 bp, Homo sapiens
agttggcctagagcaggccactgtgagctcag

SEQ ID NO: 9410 - DNA, 32 bp, Homo sapiens
acctccgcctactgggttcaagtgattctctt

SEQ ID NO: 9411 - DNA, 32 bp, Homo sapiens
ccaggctcaagcaattctcctacctcagcctc

SEQ ID NO: 9412 - DNA, 32 bp, Homo sapiens
agaagacctctggctttcctggaacacagatg

SEQ ID NO: 9413 - DNA, 32 bp, Homo sapiens
gcctctgcctcccgggttcaagcaattctcct

SEQ ID NO: 9414 - DNA, 32 bp, Homo sapiens
gaacctgggaggtggaggttgcagtgagttga

SEQ ID NO: 9415 - DNA, 32 bp, Homo sapiens
tttgcactacctgttatcagtagtgcctttac

SEQ ID NO: 9416 - DNA, 32 bp, Homo sapiens
gcctgctctctgggctggagcaggtggattcg

SEQ ID NO: 9417 - DNA, 32 bp, Homo sapiens
gaacccaggaggcggaggttgcggtgagccga

SEQ ID NO: 9418 - DNA, 32 bp, Homo sapiens
gaacccaggaggtggaggttgcagtgagtcaa

SEQ ID NO: 9419 - DNA, 32 bp, Homo sapiens
gaacccgggaggcggaggttgcggtgagccaa

SEQ ID NO: 9420 - DNA, 32 bp, Homo sapiens
gaacctgggaggcggaggttgcagtgagctga

SEQ ID NO: 9421 - DNA, 32 bp, Homo sapiens
gaacccgggaggcggaggttgcagtgagccga

SEQ ID NO: 9422 - DNA, 32 bp, Homo sapiens
gaacccaggaggcggaggttgcagtgagccaa

SEQ ID NO: 9423 - DNA, 32 bp, Homo sapiens
acatccgcctcctgggttcaagcgattctcct

SEQ ID NO: 9424 - DNA, 28 bp, Homo sapiens
gccaccattggtgctgccttctcttccc

SEQ ID NO: 9425 - DNA, 28 bp, Homo sapiens
atcagcccaagtgcttgttttattccaa

SEQ ID NO: 9426 - DNA, 32 bp, Homo sapiens
gcagtgtttgtgtccctgattacttgagatca

SEQ ID NO: 9427 - DNA, 32 bp, Homo sapiens
gtggcttttctgcgagttcttctgcctcctgc

SEQ ID NO: 9428 - DNA, 32 bp, Homo sapiens
taatgagggagggaagaaagaagaacaaataa

SEQ ID NO: 9429 - DNA, 32 bp, Homo sapiens
gtaattatagttctgttaccaagaataaataa

SEQ ID NO: 9430 - DNA, 32 bp, Homo sapiens
aggtcttcctgggggatttcagtctccacata

SEQ ID NO: 9431 - DNA, 23 bp, Homo sapiens
ctgtcgcctaggctggagtgcaa

SEQ ID NO: 9432 - DNA, 32 bp, Homo sapiens
cagcatgggaaaatgggactgtggaaataaag

SEQ ID NO: 9433 - DNA, 32 bp, Homo sapiens
agcctcctgagtagctgggactacaagtgtgc

SEQ ID NO: 9434 - DNA, 32 bp, Homo sapiens
atcctcctgagtagctggggttacaggtgtgt

SEQ ID NO: 9435 - DNA, 32 bp, Homo sapiens
tgaaccagaagtagctgggcattggagtcatg

SEQ ID NO: 9436 - DNA, 32 bp, Homo sapiens
accagggacatcctgagtttggtggctacttc

SEQ ID NO: 9437 - DNA, 32 bp, Homo sapiens
ccttcttatttaagacttcccaccttactaaa

SEQ ID NO: 9438 - DNA, 32 bp, Homo sapiens
ggaccctcaccaactttccccacctcaggcag

SEQ ID NO: 9439 - DNA, 32 bp, Homo sapiens
ctcctgctgaggtggagattgcagtgaactaa

SEQ ID NO: 9440 - DNA, 32 bp, Homo sapiens
ctcagttgcccagactggagagcagtggccaa

SEQ ID NO: 9441 - DNA, 32 bp, Homo sapiens
agaatgcattccctgaatctgtgcctgcactg

SEQ ID NO: 9442 - DNA, 24 bp, Homo sapiens
tcacacctgtaatctgaacacttt

SEQ ID NO: 9443 - DNA, 28 bp, Homo sapiens
gggttcccgtctgctgcctctcggagag

SEQ ID NO: 9444 - DNA, 32 bp, Homo sapiens
tgtctcctttggctgaggagagtgtcctggcc

SEQ ID NO: 9445 - DNA, 32 bp, Homo sapiens
ccccaagcctccatttcctcagaagtcaaaca

SEQ ID NO: 9446 - DNA, 32 bp, Homo sapiens
tcctcgtgcctgctgctcacagcccccgagag

SEQ ID NO: 9447 - DNA, 32 bp, Homo sapiens
ttttcagacctggacacggaggcacagggtgc

SEQ ID NO: 9448 - DNA, 32 bp, Homo sapiens
aaccttcgcctctgggttcaagtgattctcct

SEQ ID NO: 9449 - DNA, 32 bp, Homo sapiens
cggaaagtctcatccacccccacatcgcctct

SEQ ID NO: 9450 - DNA, 32 bp, Homo sapiens
agtctcctgagcagctgggattacaggcaaac

SEQ ID NO: 9451 - DNA, 32 bp, Homo sapiens
aagcacaagactgcgtttgtggaacacctgaa

SEQ ID NO: 9452 - DNA, 32 bp, Homo sapiens
gagaggttaagcaatttgcctaggttcacaca

SEQ ID NO: 9453 - DNA, 32 bp, Homo sapiens
ccaaagggtaatccccaagacaatgggtaaaa

SEQ ID NO: 9454 - DNA, 32 bp, Homo sapiens
ttataatgcattttactcccagtattatgttc

SEQ ID NO: 9455 - DNA, 28 bp, Homo sapiens
cccggtctcaagtaggcctcatctgccg

SEQ ID NO: 9456 - DNA, 32 bp, Homo sapiens
atcgatagcccaggcaggagtacagtggcaca

SEQ ID NO: 9457 - DNA, 21 bp, Homo sapiens
cttggactgtagtccttcccc

SEQ ID NO: 9458 - DNA, 32 bp, Homo sapiens
cattagttgtctctccccagctagattgtaag

SEQ ID NO: 9459 - DNA, 32 bp, Homo sapiens
ttgccccgtctcaaccccatctgactacccca

SEQ ID NO: 9460 - DNA, 32 bp, Homo sapiens
agaggaggaagaggaggagaaggcgaggccac

SEQ ID NO: 9461 - DNA, 32 bp, Homo sapiens
ctgcagagcaattccatcagtgacgcaggagt

SEQ ID NO: 9462 - DNA, 21 bp, Homo sapiens
cacacagcctagcacagcagc

SEQ ID NO: 9463 - DNA, 32 bp, Homo sapiens
atctgaatgtgtttctggaaatggaccagcat

SEQ ID NO: 9464 - DNA, 32 bp, Homo sapiens
aaggttgaacaacatggctcagagtcttgttc

SEQ ID NO: 9465 - DNA, 32 bp, Homo sapiens
actctgtcacccaggctgaagtgcagtggtac

SEQ ID NO: 9466 - DNA, 32 bp, Homo sapiens
agccccagctcctcttcttgccccgcatatcc

SEQ ID NO: 9467 - DNA, 32 bp, Homo sapiens
attatgtactatcaaacccccaagatgctgat

SEQ ID NO: 9468 - DNA, 32 bp, Homo sapiens
tgcctcctgagtagctgggattacaggcgtgt

SEQ ID NO: 9469 - DNA, 32 bp, Homo sapiens
agcctctcgagtagctgggactacaggcgtgc

SEQ ID NO: 9470 - DNA, 32 bp, Homo sapiens
ctctgtcgcccaggctggagtgagtgcagtgg

SEQ ID NO: 9471 - DNA, 32 bp, Homo sapiens
ctggcttcaaacaattctcatgcctcagcctc

SEQ ID NO: 9472 - DNA, 32 bp, Homo sapiens
caggaggctgaggcaggagaattcttttaacc

SEQ ID NO: 9473 - DNA, 21 bp, Homo sapiens
tgcctgtaatcccagcacttt

SEQ ID NO: 9474 - DNA, 32 bp, Homo sapiens
ctactcgggaggctgaggcgggagaatcactt

SEQ ID NO: 9475 - DNA, 32 bp, Homo sapiens
ctcagttgcccaggctggattgcggtggcgct

SEQ ID NO: 9476 - DNA, 17 bp, Homo sapiens
gccatccagcacccaga

SEQ ID NO: 9477 - DNA, 32 bp, Homo sapiens
agcccaggagcctctctgaaggaccagtctgg

SEQ ID NO: 9478 - DNA, 32 bp, Homo sapiens
atttcacagctttcacatagcacagataactc

SEQ ID NO: 9479 - DNA, 32 bp, Homo sapiens
aggatggcagaactggtcctctgcaagaaaca

SEQ ID NO: 9480 - DNA, 22 bp, Homo sapiens
cctagcagcctctcctcgggca

SEQ ID NO: 9481 - DNA, 24 bp, Homo sapiens
tggcgtgatcttggcttactgcag

SEQ ID NO: 9482 - DNA, 32 bp, Homo sapiens
ccagatgttgttctgtcagttgccaaaggact

SEQ ID NO: 9483 - DNA, 32 bp, Homo sapiens
aggcacccagttcctgacttcccagaggcttc

SEQ ID NO: 9484 - DNA, 32 bp, Homo sapiens
ttcaagtttcatggtgattatagcacagctcc

SEQ ID NO: 9485 - DNA, 32 bp, Homo sapiens
acctccgcatcccgggttcaagagattctgcc

SEQ ID NO: 9486 - DNA, 32 bp, Homo sapiens
gtgtcatgcctgcaatcccagcactttgggag

SEQ ID NO: 9487 - DNA, 32 bp, Homo sapiens
gcaggccagacacagtctgatgccagctggga

SEQ ID NO: 9488 - DNA, 32 bp, Homo sapiens
atctccatctcccgggttcaagcgattctcct

SEQ ID NO: 9489 - DNA, 32 bp, Homo sapiens
ctctgttgcccagactggagtgcagtggtgtg

SEQ ID NO: 9490 - DNA, 32 bp, Homo sapiens
gagactggaacagtttccatggtgctggagga

SEQ ID NO: 9491 - DNA, 32 bp, Homo sapiens
ttgggctcaagtgatcctcccacctcagcctc

SEQ ID NO: 9492 - DNA, 32 bp, Homo sapiens
ctctgtcgcccaggctggagtgcagtggtacg

SEQ ID NO: 9493 - DNA, 32 bp, Homo sapiens
ctctgtcacccaggctggagtgcagtggtaca

SEQ ID NO: 9494 - DNA, 32 bp, Homo sapiens
ctctgttgcccaggctggagtgcagtggtatg

SEQ ID NO: 9495 - DNA, 32 bp, Homo sapiens
gaaattggaaagcagaggttgcagtgagctga

SEQ ID NO: 9496 - DNA, 32 bp, Homo sapiens
ggtcggaaatggcagaggtggaggagacactg

SEQ ID NO: 9497 - DNA, 32 bp, Homo sapiens
ctctgtcgcccaggctggagtacagtggtgcg

SEQ ID NO: 9498 - DNA, 21 bp, Homo sapiens
acctttccattgttgcatctt

SEQ ID NO: 9499 - DNA, 32 bp, Homo sapiens
ctactcgggaggctgagacaggagaatcgctt

SEQ ID NO: 9500 - DNA, 32 bp, Homo sapiens
gaaccccggaggcagaggtttcagtgagccga

SEQ ID NO: 9501 - DNA, 32 bp, Homo sapiens
ctgcttgggatgtgttctttggcagcttgtga

SEQ ID NO: 9502 - DNA, 32 bp, Homo sapiens
ccccttcccagtcgtgacaaccacagatggcc

SEQ ID NO: 9503 - DNA, 32 bp, Homo sapiens
agcctccaacttctcccgaatcccactggatt

SEQ ID NO: 9504 - DNA, 32 bp, Homo sapiens
ctctctgctacagcttcttggctggctctgaa

SEQ ID NO: 9505 - DNA, 32 bp, Homo sapiens
tcttgttgtccaggctagagtgcaatggcatg

SEQ ID NO: 9506 - DNA, 32 bp, Homo sapiens
actacggggcggtgcctgctgtggaaatgcct

SEQ ID NO: 9507 - DNA, 32 bp, Homo sapiens
agggacagagcctctttctctgagaactacca

SEQ ID NO: 9508 - DNA, 32 bp, Homo sapiens
cagatacttatccattatgtgtctatagttca

SEQ ID NO: 9509 - DNA, 32 bp, Homo sapiens
agctcctctgcagcttcctcctcagcctccct

SEQ ID NO: 9510 - DNA, 32 bp, Homo sapiens
ctcttgtcaaccgggctggagtgcagtggtgc

SEQ ID NO: 9511 - DNA, 32 bp, Homo sapiens
cccccgcctgctgtgcacccagctccagtgtc

SEQ ID NO: 9512 - DNA, 32 bp, Homo sapiens
caccgcctatcctgagaacacagtcagtgagg

SEQ ID NO: 9513 - DNA, 32 bp, Homo sapiens
gttaaaacaacaacaacactatcctataaact

SEQ ID NO: 9514 - DNA, 32 bp, Homo sapiens
tacaactcaagcattcctcccaccttggtctc

SEQ ID NO: 9515 - DNA, 32 bp, Homo sapiens
ccaggttcaagcgattctcccgcctcagtagc

SEQ ID NO: 9516 - DNA, 32 bp, Homo sapiens
agcctcacgagtagctgggactacaggcatgc

SEQ ID NO: 9517 - DNA, 23 bp, Homo sapiens
tcacgcctgtaatccaacacttt

SEQ ID NO: 9518 - DNA, 23 bp, Homo sapiens
catgccagctgggcatgacccca

SEQ ID NO: 9519 - DNA, 32 bp, Homo sapiens
gaatccccgaggcggaggttgcactgagccga

SEQ ID NO: 9520 - DNA, 32 bp, Homo sapiens
aactcaagggcctgaagctcccagaagcttcc

SEQ ID NO: 9521 - DNA, 32 bp, Homo sapiens
tccattctagaattatgagaccaccttggaga

SEQ ID NO: 9522 - DNA, 32 bp, Homo sapiens
cctagttctccaaattcacttctgccttcctc

SEQ ID NO: 9523 - DNA, 32 bp, Homo sapiens
aggacctttggaaatcagcaatgtggtgatgg

SEQ ID NO: 9524 - DNA, 32 bp, Homo sapiens
agcctcctgagtagctgggattacaggtgtat

SEQ ID NO: 9525 - DNA, 32 bp, Homo sapiens
ctctgtcgcccaggttggagtgcagtggtgca

SEQ ID NO: 9526 - DNA, 32 bp, Homo sapiens
ccgggttcaagcaattctccttcttcagcctc

SEQ ID NO: 9527 - DNA, 32 bp, Homo sapiens
ccgggctcaagtgattctcccgcctcagtctc

SEQ ID NO: 9528 - DNA, 32 bp, Homo sapiens
ctctgttgcccaggctggagtgcggtggtgcg

SEQ ID NO: 9529 - DNA, 32 bp, Homo sapiens
ttcagcagtccaggctgatgcagtggcttcaa

SEQ ID NO: 9530 - DNA, 32 bp, Homo sapiens
ctctgttacccaggctggagtgcagtggtgcg

SEQ ID NO: 9531 - DNA, 32 bp, Homo sapiens
atcactaggaggcagaggttgcagtgagcagt

SEQ ID NO: 9532 - DNA, 32 bp, Homo sapiens
gagcctgggaggtcaaggctgcagtgaaccat

SEQ ID NO: 9533 - DNA, 32 bp, Homo sapiens
gagcccaggagattgaggctgcagtgagccat

SEQ ID NO: 9534 - DNA, 32 bp, Homo sapiens
acctccacttctcaggttcaagcaattctcct

SEQ ID NO: 9535 - DNA, 32 bp, Homo sapiens
gaacccgggaggcagagcttgcagtaagccga

SEQ ID NO: 9536 - DNA, 32 bp, Homo sapiens
gaatccgggaggtggaggttgcagtgagccaa

SEQ ID NO: 9537 - DNA, 32 bp, Homo sapiens
cctgaggctgtctcctgggaatgctggaccag

SEQ ID NO: 9538 - DNA, 22 bp, Homo sapiens
cacgcctgtaatcccagctact

SEQ ID NO: 9539 - DNA, 26 bp, Homo sapiens
tcacaggtgctctgctcgtggcccca

SEQ ID NO: 9540 - DNA, 32 bp, Homo sapiens
gccagttggcccaggcccctggcagtgctccc

SEQ ID NO: 9541 - DNA, 23 bp, Homo sapiens
tggcgaaatctcagctcactgca

SEQ ID NO: 9542 - DNA, 32 bp, Homo sapiens
aagtgccttcaaggagcttacgttctagttag

SEQ ID NO: 9543 - DNA, 32 bp, Homo sapiens
ctctgtcacccaggctggagtgcagtggtgtg

SEQ ID NO: 9544 - DNA, 32 bp, Homo sapiens
tcttgttgcccaggctgcagtgcaatggcaca

SEQ ID NO: 9545 - DNA, 32 bp, Homo sapiens
ctctgttgcccaggctggagtgcagtggtgca

SEQ ID NO: 9546 - DNA, 32 bp, Homo sapiens
ctctgtcaccccggctggagtgcagtggtgtg

SEQ ID NO: 9547 - DNA, 32 bp, Homo sapiens
cagctgtgatgcattattgagcactttagctg

SEQ ID NO: 9548 - DNA, 23 bp, Homo sapiens
tggcatgttcatggctcactgca

SEQ ID NO: 9549 - DNA, 27 bp, Homo sapiens
aatggggatgcaaataaagtttgtggg

SEQ ID NO: 9550 - DNA, 32 bp, Homo sapiens
gaacccgggagttggaggttgcagtgagccaa

SEQ ID NO: 9551 - DNA, 32 bp, Homo sapiens
tggagtgtgacggaggcatggggcctgtgctc

SEQ ID NO: 9552 - DNA, 32 bp, Homo sapiens
ttcctgtcacccaggctggagtacagtggcgt

SEQ ID NO: 9553 - DNA, 32 bp, Homo sapiens
catctgtcacccaggctggagtgcagtagtgc

SEQ ID NO: 9554 - DNA, 32 bp, Homo sapiens
agtctcctgagtagctgggattacgggtgcgt

SEQ ID NO: 9555 - DNA, 32 bp, Homo sapiens
ctctgtcacccaggctggagtgcagtgctgtg

SEQ ID NO: 9556 - DNA, 32 bp, Homo sapiens
aggaacctgcctgaatttatggcattagtggt

SEQ ID NO: 9557 - DNA, 32 bp, Homo sapiens
ctgccttcgcgttgctggggtgcagtgagact

SEQ ID NO: 9558 - DNA, 32 bp, Homo sapiens
ctgccctctgcagccctctgccagcctcttgg

SEQ ID NO: 9559 - DNA, 32 bp, Homo sapiens
ctcccataaagaggaggaaaaggaagatacag

SEQ ID NO: 9560 - DNA, 32 bp, Homo sapiens
gaacctgggaggcagagcttgcagtaagccga

SEQ ID NO: 9561 - DNA, 32 bp, Homo sapiens
agacgaaatttggccagacacagggttccttg

SEQ ID NO: 9562 - DNA, 32 bp, Homo sapiens
ccatcccttaggtgagcttcaatctaagcatc

SEQ ID NO: 9563 - DNA, 32 bp, Homo sapiens
ctccttcctctcctctctcttcttgcttagct

SEQ ID NO: 9564 - DNA, 32 bp, Homo sapiens
actaaaaatgttctgtgaaaacaagcagctag

SEQ ID NO: 9565 - DNA, 32 bp, Homo sapiens
gaatctgaacaacagtcttcagccctagactt

SEQ ID NO: 9566 - DNA, 32 bp, Homo sapiens
cccttgttcagaaatggccactgtaggaaagc

SEQ ID NO: 9567 - DNA, 32 bp, Homo sapiens
gttttgaactcctggcctcaagcaatccactc

SEQ ID NO: 9568 - DNA, 32 bp, Homo sapiens
tttctcgcacaggcttggagtgcagtggtgcg

SEQ ID NO: 9569 - DNA, 32 bp, Homo sapiens
aatttgcacatcccaagttgctatgtgaatag

SEQ ID NO: 9570 - DNA, 32 bp, Homo sapiens
aacaaaaagaattgcccacgctgtggaagata

SEQ ID NO: 9571 - DNA, 28 bp, Homo sapiens
cccttgccctgggctgcctcctcctgag

SEQ ID NO: 9572 - DNA, 32 bp, Homo sapiens
gaacccaggaggaggagcttgcagtgagccga

SEQ ID NO: 9573 - DNA, 32 bp, Homo sapiens
ccctgttgcccaggctggagtgcagtgggatg

SEQ ID NO: 9574 - DNA, 32 bp, Homo sapiens
gctctgtcgccaagttggagtgcaatggtgcg

SEQ ID NO: 9575 - DNA, 32 bp, Homo sapiens
tctgctttttcagcttctccatcgcctgcctt

SEQ ID NO: 9576 - DNA, 32 bp, Homo sapiens
ttttcttatcttctccgagctctagactggct

SEQ ID NO: 9577 - DNA, 32 bp, Homo sapiens
aaatgaaagcctttttgcatgtacttgatact

SEQ ID NO: 9578 - DNA, 21 bp, Homo sapiens
tgggagcctggggcaggagaa

SEQ ID NO: 9579 - DNA, 32 bp, Homo sapiens
catggctaggcccagaaacacagggtccaacc

SEQ ID NO: 9580 - DNA, 32 bp, Homo sapiens
tgttgttgcccaggctggagtgcaatggcgcg

SEQ ID NO: 9581 - DNA, 32 bp, Homo sapiens
ctcttattgcccaggctagagtgcaatggtgc

SEQ ID NO: 9582 - DNA, 32 bp, Homo sapiens
ctcttgttgcccaagctggagtgcagtggtgc

SEQ ID NO: 9583 - DNA, 32 bp, Homo sapiens
ctctttctctgtgcctgctccttatgagtgca

SEQ ID NO: 9584 - DNA, 32 bp, Homo sapiens
gcctcatactcctgggctcaagcaatcctcct

SEQ ID NO: 9585 - DNA, 32 bp, Homo sapiens
ctctgtctccgaggctggagtgcaatgttgca

SEQ ID NO: 9586 - DNA, 32 bp, Homo sapiens
tacagacacaagaacaatctttgctataattg

SEQ ID NO: 9587 - DNA, 32 bp, Homo sapiens
agctggacatactgctggagtccagtgctttc

SEQ ID NO: 9588 - DNA, 32 bp, Homo sapiens
ccactgtactccagcctggacaacagcgagag

SEQ ID NO: 9589 - DNA, 32 bp, Homo sapiens
gaacccgggaggcagaggttgcactgagctga

SEQ ID NO: 9590 - DNA, 32 bp, Homo sapiens
gggagtcgcccaggctggagagcggtggcgcg

SEQ ID NO: 9591 - DNA, 32 bp, Homo sapiens
ttgagttccttctctcccatctggatctccca

SEQ ID NO: 9592 - DNA, 32 bp, Homo sapiens
acctaccattggagagcttggttccttgcctc

SEQ ID NO: 9593 - DNA, 32 bp, Homo sapiens
gggacgggaggaggagaaaggtggaggagaag

SEQ ID NO: 9594 - DNA, 22 bp, Homo sapiens
tgaccttatgccattccatata

SEQ ID NO: 9595 - DNA, 32 bp, Homo sapiens
gttcatgagatgcattctcttctgtctttggt

SEQ ID NO: 9596 - DNA, 32 bp, Homo sapiens
cctcagtctgcagctcttttctccaccgcgcg

SEQ ID NO: 9597 - DNA, 32 bp, Homo sapiens
agattaaatgttcttttccaaatggggagttt

SEQ ID NO: 9598 - DNA, 21 bp, Homo sapiens
cagggaagggaccctccaccc

SEQ ID NO: 9599 - DNA, 32 bp, Homo sapiens
taaatgggcctctcttcctttgctgtgcactt

SEQ ID NO: 9600 - DNA, 32 bp, Homo sapiens
cggaccagctcagcctctgataagctggactc

SEQ ID NO: 9601 - DNA, 32 bp, Homo sapiens
tgccttcctagagttgggttgtcactgtcctg

SEQ ID NO: 9602 - DNA, 32 bp, Homo sapiens
ctctgttgcccaggctggagtacagtggtcac

SEQ ID NO: 9603 - DNA, 32 bp, Homo sapiens
ctcttgtcacctaggccagagtgcagtgtcat

SEQ ID NO: 9604 - DNA, 23 bp, Homo sapiens
tcacacctataatcccaacactt

SEQ ID NO: 9605 - DNA, 32 bp, Homo sapiens
ctgtgaagaagaggagaaaagcaatcctcctg

SEQ ID NO: 9606 - DNA, 32 bp, Homo sapiens
ggagagggaagaggagagaaaagacagggact

SEQ ID NO: 9607 - DNA, 32 bp, Homo sapiens
cgaggagcctgagagacccacggaggcttcgc

SEQ ID NO: 9608 - DNA, 17 bp, Homo sapiens
gcccctgcccttttagg

SEQ ID NO: 9609 - DNA, 24 bp, Homo sapiens
tcatgcctataatcccaggacttt

SEQ ID NO: 9610 - DNA, 32 bp, Homo sapiens
tgattgagtctatttttcactgatctcagcaa

SEQ ID NO: 9611 - DNA, 32 bp, Homo sapiens
ggttgagaacaacagtcaaaccctcttcttcc

SEQ ID NO: 9612 - DNA, 32 bp, Homo sapiens
ctgctgctgctgctgcctgcggcccggggctg

SEQ ID NO: 9613 - DNA, 32 bp, Homo sapiens
tcaggccaacagggcttcctgggatacaagag

SEQ ID NO: 9614 - DNA, 32 bp, Homo sapiens
ttaatgaccaggctctatgtgctgctgtagtg

SEQ ID NO: 9615 - DNA, 32 bp, Homo sapiens
cctggctcaagcaattctcctatgtcagcctc

SEQ ID NO: 9616 - DNA, 32 bp, Homo sapiens
agccttccgagtagctgggattacagggatgt

SEQ ID NO: 9617 - DNA, 32 bp, Homo sapiens
aggtaaccaagtgcctctaagtcatgcttatt

SEQ ID NO: 9618 - DNA, 32 bp, Homo sapiens
tcagccgggaggcccagagtgttctgcagagg

SEQ ID NO: 9619 - DNA, 32 bp, Homo sapiens
gaacccgggaggcagaggttgcagccggctga

SEQ ID NO: 9620 - DNA, 32 bp, Homo sapiens
gtgactggtctgctgctgcaggcttcatctaa

SEQ ID NO: 9621 - DNA, 32 bp, Homo sapiens
ttagaaatgctcagacttccccagaaatgaac

SEQ ID NO: 9622 - DNA, 32 bp, Homo sapiens
cagttgttccagggagcttctacctggaaaag

SEQ ID NO: 9623 - DNA, 32 bp, Homo sapiens
ccacttcgtctcctgaatcttgttctgctgcc

SEQ ID NO: 9624 - DNA, 32 bp, Homo sapiens
ctgggttcaagcaattctcatgcctctgcctc

SEQ ID NO: 9625 - DNA, 32 bp, Homo sapiens
acctccacctcccaggttcaagcaattctctg

SEQ ID NO: 9626 - DNA, 32 bp, Homo sapiens
atggaagacagaggagaagaagatgattcttt

SEQ ID NO: 9627 - DNA, 32 bp, Homo sapiens
gaacccaggaggcggaggttgcactgagccga

SEQ ID NO: 9628 - DNA, 32 bp, Homo sapiens
cactgtcacccaggctgctggagtacagtggc

SEQ ID NO: 9629 - DNA, 32 bp, Homo sapiens
ctctgttgcccgggctggagtgcagcggcgtg

SEQ ID NO: 9630 - DNA, 32 bp, Homo sapiens
actctgtgcctggcttctcttgcctgccttgg

SEQ ID NO: 9631 - DNA, 32 bp, Homo sapiens
aatagtactgcagcttcttgtggcctacagtg

SEQ ID NO: 9632 - DNA, 32 bp, Homo sapiens
cctctcagaagagggtggaagatgaaatgaaa

SEQ ID NO: 9633 - DNA, 32 bp, Homo sapiens
cgctctgtcaccaggctggagtgcagtgacac

SEQ ID NO: 9634 - DNA, 32 bp, Homo sapiens
gttattcaaaagggagtggagtgcagtcatgc

SEQ ID NO: 9635 - DNA, 32 bp, Homo sapiens
aagggtcatccctaaaggcaaaaacagaactt

SEQ ID NO: 9636 - DNA, 32 bp, Homo sapiens
aggcccctgagtagctgggattacaggcacgt

SEQ ID NO: 9637 - DNA, 32 bp, Homo sapiens
cacagctgtaccacatggcccacgtgaaatct

SEQ ID NO: 9638 - DNA, 32 bp, Homo sapiens
ggtggcagcttgtgccagagtgacacaggctt

SEQ ID NO: 9639 - DNA, 18 bp, Homo sapiens
cgcccccaccctgtccag

SEQ ID NO: 9640 - DNA, 32 bp, Homo sapiens
agcctctcgagtagctgggattacaggcacct

SEQ ID NO: 9641 - DNA, 23 bp, Homo sapiens
gtcgcccaggctggagtgcagtg

SEQ ID NO: 9642 - DNA, 32 bp, Homo sapiens
atgcttcctgcccttgaacatcagactccagg

SEQ ID NO: 9643 - DNA, 24 bp, Homo sapiens
ctgtggcccaggctggagtgtagt

SEQ ID NO: 9644 - DNA, 32 bp, Homo sapiens
tcctgtactctctcttctccgtgcactcagtc

SEQ ID NO: 9645 - DNA, 21 bp, Homo sapiens
ggagacagccacccacagtga

SEQ ID NO: 9646 - DNA, 23 bp, Homo sapiens
gtcacccaggctggagtgcggtg

SEQ ID NO: 9647 - DNA, 32 bp, Homo sapiens
acctggggcgagaccgggtgactgtggcagtg

SEQ ID NO: 9648 - DNA, 32 bp, Homo sapiens
gctgctggaagaaatagaagaaaacaacccac

SEQ ID NO: 9649 - DNA, 32 bp, Homo sapiens
agttacatccatctgtcatctgaagaaggagg

SEQ ID NO: 9650 - DNA, 32 bp, Homo sapiens
gctcagccccatcagtctcaaaggttaagcca

SEQ ID NO: 9651 - DNA, 32 bp, Homo sapiens
ctttgcccaagtgtgacagcactggggaggag

SEQ ID NO: 9652 - DNA, 32 bp, Homo sapiens
ctgggctcaagcagtctacccacctcagcctc

SEQ ID NO: 9653 - DNA, 32 bp, Homo sapiens
tccaggagtcaacaaaccccggctgaggctga

SEQ ID NO: 9654 - DNA, 32 bp, Homo sapiens
atctctgccttccgggttcaagtgattctcgt

SEQ ID NO: 9655 - DNA, 28 bp, Homo sapiens
tattgttccaagggagcctcatcaaaac

SEQ ID NO: 9656 - DNA, 32 bp, Homo sapiens
ctgcattcaagtgccctgctacaattctggct

SEQ ID NO: 9657 - DNA, 24 bp, Homo sapiens
tcatgcctggaatcctagcacttt

SEQ ID NO: 9658 - DNA, 32 bp, Homo sapiens
gcccaaggaggaggaagaggaaaacaagacaa

SEQ ID NO: 9659 - DNA, 32 bp, Homo sapiens
gaattaaagaaagaggaaagaaacacaaaaag

SEQ ID NO: 9660 - DNA, 32 bp, Homo sapiens
cctcgacatcttcctcctctactggtaaccaa

SEQ ID NO: 9661 - DNA, 19 bp, Homo sapiens
gcccctgccgactccaggt

SEQ ID NO: 9662 - DNA, 23 bp, Homo sapiens
tcatgcctgaatctcagcacttt

SEQ ID NO: 9663 - DNA, 32 bp, Homo sapiens
gctctgtcgcccaagctggagtacagtggtgc

SEQ ID NO: 9664 - DNA, 32 bp, Homo sapiens
ggtatgtgccagctggtttagcattcaatatg

SEQ ID NO: 9665 - DNA, 32 bp, Homo sapiens
ctctcagaccttttgtcacagggctacaggac

SEQ ID NO: 9666 - DNA, 32 bp, Homo sapiens
cgaacctcaggtgatccacccacctcagcctc

SEQ ID NO: 9667 - DNA, 32 bp, Homo sapiens
gttataaagaattggtttcttggaaagcaggc

SEQ ID NO: 9668 - DNA, 32 bp, Homo sapiens
aaagctattgagcgtttgctggaacacattat

SEQ ID NO: 9669 - DNA, 28 bp, Homo sapiens
tccctttatgggtctgcctcattggatt

SEQ ID NO: 9670 - DNA, 32 bp, Homo sapiens
ctttgttgcccaggctggagtgccttggcgcg

SEQ ID NO: 9671 - DNA, 32 bp, Homo sapiens
cagacctcaggtgatccgcccacctcggcctc

SEQ ID NO: 9672 - DNA, 32 bp, Homo sapiens
gatgcctctgcagccacaattctgacctaagt

SEQ ID NO: 9673 - DNA, 32 bp, Homo sapiens
atctttggagaaggagaaagaaaggaaagaac

SEQ ID NO: 9674 - DNA, 32 bp, Homo sapiens
ttcactaggagaggagaaacacaatggccacc

SEQ ID NO: 9675 - DNA, 32 bp, Homo sapiens
ctcttgtcactcaggctggagtgcagtggtgt

SEQ ID NO: 9676 - DNA, 32 bp, Homo sapiens
cacaggcatctgctgctgctcctggctgccac

SEQ ID NO: 9677 - DNA, 32 bp, Homo sapiens
ccgcccaggctggactgcagtgacacaatctc

SEQ ID NO: 9678 - DNA, 32 bp, Homo sapiens
agctccccaagtagctgggactagaggcatgc

SEQ ID NO: 9679 - DNA, 32 bp, Homo sapiens
tttggaactgtgtttcaaatggactgttacag

SEQ ID NO: 9680 - DNA, 32 bp, Homo sapiens
ccgacctcaggtgatccacccacctcggcctc

SEQ ID NO: 9681 - DNA, 32 bp, Homo sapiens
ctgggttcaagcaattctacctcagtctcctg

SEQ ID NO: 9682 - DNA, 32 bp, Homo sapiens
ctctgtctcccaggctagagtgcaatggcaca

SEQ ID NO: 9683 - DNA, 32 bp, Homo sapiens
ctctgtcacccaggcaggagtgcagtggcaca

SEQ ID NO: 9684 - DNA, 32 bp, Homo sapiens
agcctttgcacaggctggctgcgtgttcttga

SEQ ID NO: 9685 - DNA, 32 bp, Homo sapiens
tgctctatcaccaggtgggagtgcagtggcac

SEQ ID NO: 9686 - DNA, 32 bp, Homo sapiens
tcttgtactaggatctagcatatttcactatt

SEQ ID NO: 9687 - DNA, 30 bp, Homo sapiens
ttgagatggagttttcgctcttgttgccca

SEQ ID NO: 9688 - DNA, 32 bp, Homo sapiens
ctctgtctcccaggctggagtgcagtggcaca

SEQ ID NO: 9689 - DNA, 32 bp, Homo sapiens
agcgtggagacggatgggaattctgcagccac

SEQ ID NO: 9690 - DNA, 32 bp, Homo sapiens
tattatttgttagaggagtgacttgatttgaa

SEQ ID NO: 9691 - DNA, 32 bp, Homo sapiens
agcctcctgagtagctgggattacaggtgtgc

SEQ ID NO: 9692 - DNA, 32 bp, Homo sapiens
ggcctcccaagtagctgggattacaggtgtgt

SEQ ID NO: 9693 - DNA, 32 bp, Homo sapiens
acttccgcatcccaggttcaagcgattctccc

SEQ ID NO: 9694 - DNA, 32 bp, Homo sapiens
ccgggttcaagcaattctcatgcctcagcctc

SEQ ID NO: 9695 - DNA, 32 bp, Homo sapiens
ctgggttcaagaaattctcctgccttagcctc

SEQ ID NO: 9696 - DNA, 32 bp, Homo sapiens
gaaattccaggtcttcttgcttaacttatatg

SEQ ID NO: 9697 - DNA, 28 bp, Homo sapiens
aaagatccaagtgctttcttttcatttc

SEQ ID NO: 9698 - DNA, 32 bp, Homo sapiens
gtcgctgtcattctgtcattgctgctactcta

SEQ ID NO: 9699 - DNA, 32 bp, Homo sapiens
tcttgtcgctcagcctggagtgcagtgagctg

SEQ ID NO: 9700 - DNA, 24 bp, Homo sapiens
tcacaccggtaatcccagcacttt

SEQ ID NO: 9701 - DNA, 24 bp, Homo sapiens
tcacgcctagaatcccagcacttt

SEQ ID NO: 9702 - DNA, 32 bp, Homo sapiens
gaattatagaagatgtgaagaaaacaacacac

SEQ ID NO: 9703 - DNA, 22 bp, Homo sapiens
actcaggtgctgaagggtaata

SEQ ID NO: 9704 - DNA, 23 bp, Homo sapiens
agcacaagccatacatcgcaggt

SEQ ID NO: 9705 - DNA, 32 bp, Homo sapiens
agagatgtatggggatcacctttgccagagct

SEQ ID NO: 9706 - DNA, 32 bp, Homo sapiens
ctacccacttccattcccgtggtctccttgca

SEQ ID NO: 9707 - DNA, 32 bp, Homo sapiens
agcaggttgcccaccaagctggaaggcagtga

SEQ ID NO: 9708 - DNA, 32 bp, Homo sapiens
taggaggagttagagggaagttgaaagccaac

SEQ ID NO: 9709 - DNA, 32 bp, Homo sapiens
aggaattgcccagcagacgttgggtgagtctg

SEQ ID NO: 9710 - DNA, 32 bp, Homo sapiens
cacatctcctagagctgggaatgtgtccctaa

SEQ ID NO: 9711 - DNA, 32 bp, Homo sapiens
acaagctggaccccctgctcccgggggcgagc

SEQ ID NO: 9712 - DNA, 28 bp, Homo sapiens
atatcaatccatgctgcctgatccctgt

SEQ ID NO: 9713 - DNA, 32 bp, Homo sapiens
actctgtcgccaggctggaatgcagtagggca

SEQ ID NO: 9714 - DNA, 32 bp, Homo sapiens
attgacacattcatttttctttgcttatttga

SEQ ID NO: 9715 - DNA, 32 bp, Homo sapiens
acagtccctcttctccccaggaccccagggcc

SEQ ID NO: 9716 - DNA, 32 bp, Homo sapiens
gagaggaaacatcttaccatctggtcattcat

SEQ ID NO: 9717 - DNA, 32 bp, Homo sapiens
gcacttagaagaggacaggagatagtaaaagg

SEQ ID NO: 9718 - DNA, 32 bp, Homo sapiens
tgaacacccaaaacgccattgccttccgcaga

SEQ ID NO: 9719 - DNA, 32 bp, Homo sapiens
gctgaatggactccgtgaaaatggcagacacg

SEQ ID NO: 9720 - DNA, 32 bp, Homo sapiens
tgtgggcatcttctgcccatgggctccatttg

SEQ ID NO: 9721 - DNA, 32 bp, Homo sapiens
cctatcaattgggctgatgatgtcagtgttcc

SEQ ID NO: 9722 - DNA, 32 bp, Homo sapiens
acggtgctgctgctgcacggcctatcgcagaa

SEQ ID NO: 9723 - DNA, 32 bp, Homo sapiens
ggtaccaagagactccttgagagaccaggcaa

SEQ ID NO: 9724 - DNA, 32 bp, Homo sapiens
ctctgtagcccaggctggagtgcagtgtggca

SEQ ID NO: 9725 - DNA, 32 bp, Homo sapiens
ctcttgttgcccaagctggagtgcagtggcgc

SEQ ID NO: 9726 - DNA, 32 bp, Homo sapiens
gcacatggattttcccttttgttttcagtgtt

SEQ ID NO: 9727 - DNA, 32 bp, Homo sapiens
gtacatctgccgtgggttcaagcgattctcct

SEQ ID NO: 9728 - DNA, 32 bp, Homo sapiens
cggagttgcccaggctggagtgcagcgcatgg

SEQ ID NO: 9729 - DNA, 32 bp, Homo sapiens
ctgacctcaggtgatctgcccacctcagcctc

SEQ ID NO: 9730 - DNA, 32 bp, Homo sapiens
cttcgttcaagcgattctcccacctcagcctc

SEQ ID NO: 9731 - DNA, 32 bp, Homo sapiens
gaacctgggaggcggaggttgcagtgaaccaa

SEQ ID NO: 9732 - DNA, 32 bp, Homo sapiens
tctggataggggatgaggttgctgtgaaagca

SEQ ID NO: 9733 - DNA, 32 bp, Homo sapiens
caaacggggaggcagagggaggagggaaggct

SEQ ID NO: 9734 - DNA, 31 bp, Homo sapiens
ggcctacacagacaaatcaggagggaacaga

SEQ ID NO: 9735 - DNA, 32 bp, Homo sapiens
gaacctgggaggtggaagctgcagtgagccaa

SEQ ID NO: 9736 - DNA, 32 bp, Homo sapiens
ggatgagggaggtcggggctgcagtgagccaa

SEQ ID NO: 9737 - DNA, 20 bp, Homo sapiens
gatgagcatacgactgggga

SEQ ID NO: 9738 - DNA, 32 bp, Homo sapiens
ggcctgctgctgtgcttcagtgacacagtaaa

SEQ ID NO: 9739 - DNA, 32 bp, Homo sapiens
tttctctctgtggcgacttttctgccttccct

SEQ ID NO: 9740 - DNA, 32 bp, Homo sapiens
agcagcttgcccagctaggagcagcagcaaca

SEQ ID NO: 9741 - DNA, 32 bp, Homo sapiens
gggaggttgcccattgtttggttgccagtcat

SEQ ID NO: 9742 - DNA, 32 bp, Homo sapiens
gacaggccagttctccattctgcaggactatc

SEQ ID NO: 9743 - DNA, 32 bp, Homo sapiens
tctctacatggtggtctagataagctaatttt

SEQ ID NO: 9744 - DNA, 32 bp, Homo sapiens
aaggcaagaagaggaggaaggaatagcacagg

SEQ ID NO: 9745 - DNA, 32 bp, Homo sapiens
cccaagctggagtacagtagtgcaatctcagc

SEQ ID NO: 9746 - DNA, 32 bp, Homo sapiens
ccatattgcccaggctggtctcgaatgcctgg

SEQ ID NO: 9747 - DNA, 32 bp, Homo sapiens
gtgagagtgctgctgttccattcctggggtcc

SEQ ID NO: 9748 - DNA, 20 bp, Homo sapiens
gcaaatgcaaacatctctgc

SEQ ID NO: 9749 - DNA, 32 bp, Homo sapiens
agtcctgttggttggtcatctttgtcacttct

SEQ ID NO: 9750 - DNA, 32 bp, Homo sapiens
tattagcttatcagctaaaatattgcatagtg

SEQ ID NO: 9751 - DNA, 32 bp, Homo sapiens
ttgagacagagtttcacttttgttgcccaggc

SEQ ID NO: 9752 - DNA, 23 bp, Homo sapiens
tggcactatcttggctcactgca

SEQ ID NO: 9753 - DNA, 32 bp, Homo sapiens
ctgtgtcacccaggctggagtgcagtggcaca

SEQ ID NO: 9754 - DNA, 32 bp, Homo sapiens
gctctttcgcccaggatggagtgcagtggtgc

SEQ ID NO: 9755 - DNA, 32 bp, Homo sapiens
ggcaggttttccaggctggagtcggttccacc

SEQ ID NO: 9756 - DNA, 32 bp, Homo sapiens
tgtgtcatccagagctggagtgcagcggcaca

SEQ ID NO: 9757 - DNA, 32 bp, Homo sapiens
ggctcatgcttgtaatcctagcactttttgag

SEQ ID NO: 9758 - DNA, 32 bp, Homo sapiens
ggagttcaagacgagcctgggcaacatggcaa

SEQ ID NO: 9759 - DNA, 32 bp, Homo sapiens
gaacccaggaagcagaggttgcagtgagcaga

SEQ ID NO: 9760 - DNA, 32 bp, Homo sapiens
tgaacctggaggcagaggttgcagtgagtcga

SEQ ID NO: 9761 - DNA, 32 bp, Homo sapiens
gaacccgggaggtggaggttgcggtgagccaa

SEQ ID NO: 9762 - DNA, 32 bp, Homo sapiens
gaacctgggaggcggaggttgcagtgagttga

SEQ ID NO: 9763 - DNA, 32 bp, Homo sapiens
gaacccaggaggtggaggttgcagtgagccaa

SEQ ID NO: 9764 - DNA, 32 bp, Homo sapiens
aagcccaggagtttgaggctgcagtgagttat

SEQ ID NO: 9765 - DNA, 32 bp, Homo sapiens
gaacccgggaggtggaggttgcagtgagccga

SEQ ID NO: 9766 - DNA, 32 bp, Homo sapiens
gaactcaggaggcggaggttgcggtgagccga

SEQ ID NO: 9767 - DNA, 32 bp, Homo sapiens
gaactcgggaggcggaggttgcagtgagccga

SEQ ID NO: 9768 - DNA, 32 bp, Homo sapiens
ggaccgagctgggcttctcttcctccctacag

SEQ ID NO: 9769 - DNA, 32 bp, Homo sapiens
gtacctgggaagcgcaggttgcagtgagctga

SEQ ID NO: 9770 - DNA, 32 bp, Homo sapiens
gaacctgggaggtggaggttgcagtgagctga

SEQ ID NO: 9771 - DNA, 24 bp, Homo sapiens
gaagaggcgccctgtgaaccctgt

SEQ ID NO: 9772 - DNA, 18 bp, Homo sapiens
cctcactgccacccagag

SEQ ID NO: 9773 - DNA, 32 bp, Homo sapiens
ctttgaggattctcttctcttttaccattttt

SEQ ID NO: 9774 - DNA, 32 bp, Homo sapiens
gctctgtcgcccaggcgggaatgcagtggcgc

SEQ ID NO: 9775 - DNA, 32 bp, Homo sapiens
gctctgtctcccgggctggagtgcagtggcgc

SEQ ID NO: 9776 - DNA, 32 bp, Homo sapiens
aacactgggcagcctcgccttgttgccaacgt

SEQ ID NO: 9777 - DNA, 32 bp, Homo sapiens
gaacccgtgtggcagaggttgcggtgagtgta

SEQ ID NO: 9778 - DNA, 32 bp, Homo sapiens
ctactcgggaggctgtggcaggagaatcgctt

SEQ ID NO: 9779 - DNA, 32 bp, Homo sapiens
tcctgcactgcagcttcctgctcctctgactc

SEQ ID NO: 9780 - DNA, 32 bp, Homo sapiens
accaccatctcctgggttcaggcgattcttcc

SEQ ID NO: 9781 - DNA, 32 bp, Homo sapiens
cttctcgggaggctgaggcaggagaatcactt

SEQ ID NO: 9782 - DNA, 32 bp, Homo sapiens
tagagatggagtttcaccatgttacccaggat

SEQ ID NO: 9783 - DNA, 32 bp, Homo sapiens
ttgagacggagattcacttttgttgcccaggc

SEQ ID NO: 9784 - DNA, 32 bp, Homo sapiens
ttctggagagcctctgcagggggtttgccatc

SEQ ID NO: 9785 - DNA, 32 bp, Homo sapiens
tatttttggccattctcataccacagacaaaa

SEQ ID NO: 9786 - DNA, 32 bp, Homo sapiens
gttgcatttccccatttcttgtttttaaaaga

SEQ ID NO: 9787 - DNA, 32 bp, Homo sapiens
atgagtcatggtcatgattataaacatcagcc

SEQ ID NO: 9788 - DNA, 32 bp, Homo sapiens
actgcttcctcacatccatctgattgcaccat

SEQ ID NO: 9789 - DNA, 32 bp, Homo sapiens
attcagcagtccaggctgatgcagtggcttca

SEQ ID NO: 9790 - DNA, 32 bp, Homo sapiens
ttttctccagttctgttacccaatttagatta

SEQ ID NO: 9791 - DNA, 32 bp, Homo sapiens
ctctgtcactcatgctggagtgcagtggcgtg

SEQ ID NO: 9792 - DNA, 32 bp, Homo sapiens
tcttgctgcccaggctggagtgcaatggtgca

SEQ ID NO: 9793 - DNA, 32 bp, Homo sapiens
tgaatgaagaatttttagctgtgcagataggt

SEQ ID NO: 9794 - DNA, 32 bp, Homo sapiens
tgtccttataagaagaggagattaggtcacag

SEQ ID NO: 9795 - DNA, 32 bp, Homo sapiens
gactgcgggaggcaggggatgcatgggtgtcc

SEQ ID NO: 9796 - DNA, 32 bp, Homo sapiens
ttcagctgcccaggcagaggagaatggggtct

SEQ ID NO: 9797 - DNA, 32 bp, Homo sapiens
ctggagaagagaggagaggagagaggcagaga

SEQ ID NO: 9798 - DNA, 28 bp, Homo sapiens
gccaccccaagtgtggttatgcctcctc

SEQ ID NO: 9799 - DNA, 32 bp, Homo sapiens
cggatctaagatgcccttagaagaccagccca

SEQ ID NO: 9800 - DNA, 20 bp, Homo sapiens
gcaccagcaccttcctacaa

SEQ ID NO: 9801 - DNA, 32 bp, Homo sapiens
atactccctgcctcctttcttctgcctaccag

SEQ ID NO: 9802 - DNA, 32 bp, Homo sapiens
aaaatttatgtctgtctcatgtgtaaaagaca

SEQ ID NO: 9803 - DNA, 32 bp, Homo sapiens
cacgcaccccgctttgcacaccacagagtgcc

SEQ ID NO: 9804 - DNA, 32 bp, Homo sapiens
aaggagggtctcttgcccatctctccggccac

SEQ ID NO: 9805 - DNA, 32 bp, Homo sapiens
ttgagacagggttttgctcttgttgcccagcc

SEQ ID NO: 9806 - DNA, 32 bp, Homo sapiens
acctccacctcccaggttcaagcaattatcct

SEQ ID NO: 9807 - DNA, 32 bp, Homo sapiens
ggccagtaacattgccaatactacctaccggc

SEQ ID NO: 9808 - DNA, 32 bp, Homo sapiens
tcaacaacaagagattgaaataagctatgggt

SEQ ID NO: 9809 - DNA, 32 bp, Homo sapiens
acctccgcctctcaggttcaagcaattctcct

SEQ ID NO: 9810 - DNA, 32 bp, Homo sapiens
gaacctagaaggtggaggttgcagtgagcgga

SEQ ID NO: 9811 - DNA, 32 bp, Homo sapiens
tgcctcccgagtagctgggattacaggcacac

SEQ ID NO: 9812 - DNA, 32 bp, Homo sapiens
agcctcccaagtagctgggattacaggcagca

SEQ ID NO: 9813 - DNA, 28 bp, Homo sapiens
atctccccaagtgcacactttatccacc

SEQ ID NO: 9814 - DNA, 32 bp, Homo sapiens
tttgatccaagtgcccacagttctgatgaatg

SEQ ID NO: 9815 - DNA, 32 bp, Homo sapiens
gagcccaggaggtcgaagctgcagtgaggtat

SEQ ID NO: 9816 - DNA, 31 bp, Homo sapiens
atcagcaacaacagcgaggatggaaatggaa

SEQ ID NO: 9817 - DNA, 23 bp, Homo sapiens
tatgcctgtaatccctgcacttt

SEQ ID NO: 9818 - DNA, 32 bp, Homo sapiens
gaagaagagagaggagaagaggaggaggcaga

SEQ ID NO: 9819 - DNA, 32 bp, Homo sapiens
atggttactgttctgtccctacaatagaatgt

SEQ ID NO: 9820 - DNA, 32 bp, Homo sapiens
gtggctgggccagcaggggccctcactcttga

SEQ ID NO: 9821 - DNA, 32 bp, Homo sapiens
caaatagtcctggttcattcccagaagggcac

SEQ ID NO: 9822 - DNA, 31 bp, Homo sapiens
ctgaggatgttcaggctggggctgctggttt

SEQ ID NO: 9823 - DNA, 24 bp, Homo sapiens
cgctccgccgccccctccaggtga

SEQ ID NO: 9824 - DNA, 32 bp, Homo sapiens
tctccagcagccagagtctcccagaaaacaac

SEQ ID NO: 9825 - DNA, 32 bp, Homo sapiens
ctttgcagctttgttagctcttaaacttccag

SEQ ID NO: 9826 - DNA, 23 bp, Homo sapiens
tggcacaatcttagctcactgca

SEQ ID NO: 9827 - DNA, 23 bp, Homo sapiens
tggtgcaatctcggctcactgca

SEQ ID NO: 9828 - DNA, 32 bp, Homo sapiens
tcagttctgctgctgtctttactgctctcaac

SEQ ID NO: 9829 - DNA, 32 bp, Homo sapiens
tgttttgggttagagagagtaagatttgagaa

SEQ ID NO: 9830 - DNA, 32 bp, Homo sapiens
agggtgagaagaggctgagagagaaggggaaa

SEQ ID NO: 9831 - DNA, 23 bp, Homo sapiens
tggcgcaatcttggctcactgca

SEQ ID NO: 9832 - DNA, 32 bp, Homo sapiens
gaacctgggaggcagagtttgcagtgagcgga

SEQ ID NO: 9833 - DNA, 32 bp, Homo sapiens
gaacccaggaggcagctgttgcagtgagccaa

SEQ ID NO: 9834 - DNA, 32 bp, Homo sapiens
agatagtgaaaacaggctattgctcttcccat

SEQ ID NO: 9835 - DNA, 32 bp, Homo sapiens
ctgccctcaggtgatccacccacctcagcctc

SEQ ID NO: 9836 - DNA, 32 bp, Homo sapiens
ccgggtccaagcaattcccctgcctcagtctc

SEQ ID NO: 9837 - DNA, 32 bp, Homo sapiens
cattgcccttcgggctggagatgctttgccgg

SEQ ID NO: 9838 - DNA, 32 bp, Homo sapiens
ggaactccagttctggggtcagaagatttaaa

SEQ ID NO: 9839 - DNA, 25 bp, Homo sapiens
gcatttgccaacttacatgctctcc

SEQ ID NO: 9840 - DNA, 32 bp, Homo sapiens
ttctgtaactgcatttttcaccttaaaagtta

SEQ ID NO: 9841 - DNA, 32 bp, Homo sapiens
ttactcgggaggctgaggcaggaggatcactt

SEQ ID NO: 9842 - DNA, 32 bp, Homo sapiens
tccctcctcccaggctggtgtgagtgtgcgtg

SEQ ID NO: 9843 - DNA, 32 bp, Homo sapiens
aagaccccgagcatccttaacatcccagcacc

SEQ ID NO: 9844 - DNA, 32 bp, Homo sapiens
atctccgggaggccctggttaaaggaggctaa

SEQ ID NO: 9845 - DNA, 24 bp, Homo sapiens
tcacacttataatcccagcacttt

SEQ ID NO: 9846 - DNA, 32 bp, Homo sapiens
gcagtagaagatggtgaaagaaacaacttact

SEQ ID NO: 9847 - DNA, 32 bp, Homo sapiens
agcctcctgagtagctgggactacaggcgccc

SEQ ID NO: 9848 - DNA, 32 bp, Homo sapiens
attgtaaacaagttcagccactgtggaagaca

SEQ ID NO: 9849 - DNA, 18 bp, Homo sapiens
tgtgggaaaaagagctgg

SEQ ID NO: 9850 - DNA, 24 bp, Homo sapiens
gcccctgcggttcctgtccgagta

SEQ ID NO: 9851 - DNA, 32 bp, Homo sapiens
ttcctggaagcaggagaaagatgaggactttg

SEQ ID NO: 9852 - DNA, 32 bp, Homo sapiens
accatggagcggaaagaaagaaaacagcattc

SEQ ID NO: 9853 - DNA, 32 bp, Homo sapiens
ctcctagtagtactttttctctctccatttaa

SEQ ID NO: 9854 - DNA, 32 bp, Homo sapiens
aggaggctctgggcggaggtgcagtgaccccg

SEQ ID NO: 9855 - DNA, 32 bp, Homo sapiens
tggaaaaggagtcaggagccactgtgaggtga

SEQ ID NO: 9856 - DNA, 32 bp, Homo sapiens
tatcccgggaattcaaggttgcagtgagctat

SEQ ID NO: 9857 - DNA, 32 bp, Homo sapiens
gaacccaggaggcagaggttgcagtgagctgt

SEQ ID NO: 9858 - DNA, 32 bp, Homo sapiens
gaacaggggagatggaggttgcagtgagctga

SEQ ID NO: 9859 - DNA, 32 bp, Homo sapiens
tgcagcccaacaaacaagggaactaggaccga

SEQ ID NO: 9860 - DNA, 32 bp, Homo sapiens
gcgctcccgaaggcgttcctggagggccctgg

SEQ ID NO: 9861 - DNA, 28 bp, Homo sapiens
ctggaaccaagtgctgaactctcacatc

SEQ ID NO: 9862 - DNA, 32 bp, Homo sapiens
tctgtccagctttccccagggtgacatacaga

SEQ ID NO: 9863 - DNA, 32 bp, Homo sapiens
agctaactcgcggccttatttctgcctttaat

SEQ ID NO: 9864 - DNA, 32 bp, Homo sapiens
aaatacgtttttggctgcgggtgcaaagggga

SEQ ID NO: 9865 - DNA, 23 bp, Homo sapiens
tggcatgatttcggctcactgca

SEQ ID NO: 9866 - DNA, 32 bp, Homo sapiens
ggatgaaggctgccaggacacagggtctggcc

SEQ ID NO: 9867 - DNA, 32 bp, Homo sapiens
cactatccggctgaggtctcccagagacaggc

SEQ ID NO: 9868 - DNA, 32 bp, Homo sapiens
ccacctcccactctgtcatggcgggatttttg

SEQ ID NO: 9869 - DNA, 32 bp, Homo sapiens
gggttttgatattggcttagctgccagtctcc

SEQ ID NO: 9870 - DNA, 23 bp, Homo sapiens
tggcgtgatctcggcttactgca

SEQ ID NO: 9871 - DNA, 32 bp, Homo sapiens
ctgggtcctgagggagagctgcagtgagaagt

SEQ ID NO: 9872 - DNA, 32 bp, Homo sapiens
tctccatcaagcaatatttccacttcaacttc

SEQ ID NO: 9873 - DNA, 32 bp, Homo sapiens
gcctccctgagtagctgggactacaggcacac

SEQ ID NO: 9874 - DNA, 32 bp, Homo sapiens
gatggcaattgagtagctgataagctgaaaat

SEQ ID NO: 9875 - DNA, 32 bp, Homo sapiens
actgatcacagattctttcccacctcacaatc

SEQ ID NO: 9876 - DNA, 32 bp, Homo sapiens
ccggattcaaggaattctccctgcctcagcct

SEQ ID NO: 9877 - DNA, 32 bp, Homo sapiens
ccaggctgaagcgatcctcccacctcaacctc

SEQ ID NO: 9878 - DNA, 32 bp, Homo sapiens
tcaggcttgcccaggaaaggggctgtgctgtc

SEQ ID NO: 9879 - DNA, 17 bp, Homo sapiens
gcccagaccacccagga

SEQ ID NO: 9880 - DNA, 32 bp, Homo sapiens
agatgacctatttgtcagtggtgcaaaattaa

SEQ ID NO: 9881 - DNA, 32 bp, Homo sapiens
acttgtgcctcctgggttcaagcgattctgct

SEQ ID NO: 9882 - DNA, 32 bp, Homo sapiens
attttctcaagcaatttttaaatttcattcat

SEQ ID NO: 9883 - DNA, 32 bp, Homo sapiens
ctggccgggcctggggtcgctgtcaacttgtt

SEQ ID NO: 9884 - DNA, 32 bp, Homo sapiens
ttaagatacttggaatagctgtggaggaagaa

SEQ ID NO: 9885 - DNA, 25 bp, Homo sapiens
ttcaaaaagtgaagccactttataa

SEQ ID NO: 9886 - DNA, 24 bp, Homo sapiens
tcacacctataatcccaacacttt

SEQ ID NO: 9887 - DNA, 32 bp, Homo sapiens
ctgacctcaagcaatctgctcgtcttagcctc

SEQ ID NO: 9888 - DNA, 30 bp, Homo sapiens
ttttcatggagtttgttcctggtggctcaa

SEQ ID NO: 9889 - DNA, 32 bp, Homo sapiens
tgtctgtcgctgctgccgcctccacccagcct

SEQ ID NO: 9890 - DNA, 32 bp, Homo sapiens
gtttgtcatccctgggtctaggaaatagtcaa

SEQ ID NO: 9891 - DNA, 32 bp, Homo sapiens
ctctgtcacccgggctggagtgctgtggcttg

SEQ ID NO: 9892 - DNA, 32 bp, Homo sapiens
ttctcttgcccaggctggagtgcagtggcacg

SEQ ID NO: 9893 - DNA, 32 bp, Homo sapiens
tattcctcctccattccatcgactcccagcac

SEQ ID NO: 9894 - DNA, 32 bp, Homo sapiens
cgttctattctgcactacaatcattttgacaa

SEQ ID NO: 9895 - DNA, 32 bp, Homo sapiens
ggaggagtggagtggagctcttgccttgttac

SEQ ID NO: 9896 - DNA, 32 bp, Homo sapiens
agcctctggagtagctgggactacaggcgtgt

SEQ ID NO: 9897 - DNA, 32 bp, Homo sapiens
ctgcctacctgaggagctttctttggaaacca

SEQ ID NO: 9898 - DNA, 32 bp, Homo sapiens
gcagcacatcttcctcctcgcaggagggacca

SEQ ID NO: 9899 - DNA, 32 bp, Homo sapiens
agatccaggcttctcccggacctggactaggg

SEQ ID NO: 9900 - DNA, 32 bp, Homo sapiens
tactccttgcctaggctggagtttacagagac

SEQ ID NO: 9901 - DNA, 32 bp, Homo sapiens
aaaaattgtagaaatatagactgtgaaaaaga

SEQ ID NO: 9902 - DNA, 32 bp, Homo sapiens
cccatccccacccgctcacaggcacacactgg

SEQ ID NO: 9903 - DNA, 32 bp, Homo sapiens
tgggattcaagcaattctcccacctcagcctc

SEQ ID NO: 9904 - DNA, 32 bp, Homo sapiens
ctgccttctcaaggagtccacagtctggagga

SEQ ID NO: 9905 - DNA, 21 bp, Homo sapiens
acttcctgggagtgttaacaa

SEQ ID NO: 9906 - DNA, 32 bp, Homo sapiens
ctgggacctgcagctctgcctttgctggctgg

SEQ ID NO: 9907 - DNA, 32 bp, Homo sapiens
cttgagctgctgctgtcactcctccaccgagg

SEQ ID NO: 9908 - DNA, 24 bp, Homo sapiens
gtcacccaggctggagtacagtga

SEQ ID NO: 9909 - DNA, 32 bp, Homo sapiens
aattgctttaaccttggaggcggaggttgcat

SEQ ID NO: 9910 - DNA, 32 bp, Homo sapiens
gctctgtcggccaggttggagtgcagtggtgc

SEQ ID NO: 9911 - DNA, 32 bp, Homo sapiens
attaaaacaaggtaggaatgaggctagacctt

SEQ ID NO: 9912 - DNA, 32 bp, Homo sapiens
gatgatacttcaggagattatatttcactcaa

SEQ ID NO: 9913 - DNA, 32 bp, Homo sapiens
agagtggtgggagaacagctgcagtgaagcac

SEQ ID NO: 9914 - DNA, 32 bp, Homo sapiens
ctgaacccaggagacaggttgcagtgagccga

SEQ ID NO: 9915 - DNA, 32 bp, Homo sapiens
aggtgtaaggtacatggatgtgctttggtcaa

SEQ ID NO: 9916 - DNA, 32 bp, Homo sapiens
ctcttgttccccaggctggagtgcaatggcac

SEQ ID NO: 9917 - DNA, 32 bp, Homo sapiens
agctagtcattcctgtcatattcccagtagaa

SEQ ID NO: 9918 - DNA, 32 bp, Homo sapiens
agccgggcttcctgggtgtttcaggcaaggaa

SEQ ID NO: 9919 - DNA, 32 bp, Homo sapiens
ttctccatctccattcttttgaatttcctcat

SEQ ID NO: 9920 - DNA, 32 bp, Homo sapiens
tgcaatgtccagcagtctgataaactgatgat

SEQ ID NO: 9921 - DNA, 32 bp, Homo sapiens
gtctgagaggagaacttcctggagccagtgcc

SEQ ID NO: 9922 - DNA, 32 bp, Homo sapiens
gctgcgcctccaggctggaccagcagttccag

SEQ ID NO: 9923 - DNA, 32 bp, Homo sapiens
cctggaggaagaggaagaggaacccaagagga

SEQ ID NO: 9924 - DNA, 32 bp, Homo sapiens
ttgactgtattcacataaatggtgctaaaaca

SEQ ID NO: 9925 - DNA, 32 bp, Homo sapiens
agcctcctgagtggctgggattataggtgtgt

SEQ ID NO: 9926 - DNA, 32 bp, Homo sapiens
cagctctctgcagtctccggctctctcctgca

SEQ ID NO: 9927 - DNA, 32 bp, Homo sapiens
agacaggttgtcttttggaaatgcaggtttaa

SEQ ID NO: 9928 - DNA, 21 bp, Homo sapiens
caggacaacacttctactgaa

SEQ ID NO: 9929 - DNA, 24 bp, Homo sapiens
tggcatgatcttggctcactgcag

SEQ ID NO: 9930 - DNA, 24 bp, Homo sapiens
tggcatgatctcggctcaccgcag

SEQ ID NO: 9931 - DNA, 32 bp, Homo sapiens
gtcccagataaccttgaggcctgggcactggc

SEQ ID NO: 9932 - DNA, 32 bp, Homo sapiens
actctgtctcccaggctagagtgcagtggtgc

SEQ ID NO: 9933 - DNA, 32 bp, Homo sapiens
actctgtctcccaggctggagtgcaatggtgc

SEQ ID NO: 9934 - DNA, 24 bp, Homo sapiens
ctaatgaaagaaaatgccctttaa

SEQ ID NO: 9935 - DNA, 32 bp, Homo sapiens
tcagcggcctggcagaggtttcagcgctgagg

SEQ ID NO: 9936 - DNA, 32 bp, Homo sapiens
tttctgcctaattaaggagaagtcttttatca

SEQ ID NO: 9937 - DNA, 32 bp, Homo sapiens
cccagtccacaccagagccccacgcggctgcc

SEQ ID NO: 9938 - DNA, 32 bp, Homo sapiens
tgaccacgtgggaacagcctgcagtgagcggt

SEQ ID NO: 9939 - DNA, 19 bp, Homo sapiens
cagaggcctgtgcccatcg

SEQ ID NO: 9940 - DNA, 32 bp, Homo sapiens
cctgcgctccttctccccgctgcaacccgggc

SEQ ID NO: 9941 - DNA, 32 bp, Homo sapiens
ccaggctcaagctgtcctcccacctcagcctc

SEQ ID NO: 9942 - DNA, 32 bp, Homo sapiens
tttaaatagctttttgctatatgataatatag

SEQ ID NO: 9943 - DNA, 32 bp, Homo sapiens
ggtccagaaagactcagccactggagtctgtg

SEQ ID NO: 9944 - DNA, 32 bp, Homo sapiens
gcccttacagtttcactcatgaagcaccttga

SEQ ID NO: 9945 - DNA, 32 bp, Homo sapiens
ccagcttccaggggactgtcactgtggacgcc

SEQ ID NO: 9946 - DNA, 32 bp, Homo sapiens
tcggcactgaggcagaggaggcaagggctggt

SEQ ID NO: 9947 - DNA, 32 bp, Homo sapiens
gagagtgggaggcagagtgtgatggggaggag

SEQ ID NO: 9948 - DNA, 32 bp, Homo sapiens
gaacccaggacgcagaggttgcggtgagccaa

SEQ ID NO: 9949 - DNA, 32 bp, Homo sapiens
atctccgcctcctgggttcaagggattctcct

SEQ ID NO: 9950 - DNA, 32 bp, Homo sapiens
acatccacctcccaggttcaagtgattcttgt

SEQ ID NO: 9951 - DNA, 32 bp, Homo sapiens
ggcctcccaagccctgataacaacatggccaa

SEQ ID NO: 9952 - DNA, 32 bp, Homo sapiens
tgaactcagcttcaagaccccacgctgctgca

SEQ ID NO: 9953 - DNA, 32 bp, Homo sapiens
gctctgtcaccaggctggagggcagtggtgcg

SEQ ID NO: 9954 - DNA, 32 bp, Homo sapiens
aggcactgtaccaccagcctactgagattgtg

SEQ ID NO: 9955 - DNA, 32 bp, Homo sapiens
gcaacccctgcagctcctctgcctttgtgctc

SEQ ID NO: 9956 - DNA, 21 bp, Homo sapiens
gatgaggaaactgagtccgga

SEQ ID NO: 9957 - DNA, 32 bp, Homo sapiens
cctgctcaagctaaacgcaccacgccggcttt

SEQ ID NO: 9958 - DNA, 32 bp, Homo sapiens
ggcagagccaggaagatcccccagaaaagaaa

SEQ ID NO: 9959 - DNA, 32 bp, Homo sapiens
ggttgttgcccaggctggagtgcagtggcgcc

SEQ ID NO: 9960 - DNA, 32 bp, Homo sapiens
caggtaagccattcctggatacctgacccttg

SEQ ID NO: 9961 - DNA, 32 bp, Homo sapiens
aggccgttgtcctgctctgaccacagagtttt

SEQ ID NO: 9962 - DNA, 23 bp, Homo sapiens
attgaaatatttgctctctgcca

SEQ ID NO: 9963 - DNA, 20 bp, Homo sapiens
ggcaaatgtgacccgcctcc

SEQ ID NO: 9964 - DNA, 28 bp, Homo sapiens
ttgcccagcagtgctgccttcagcggcc

SEQ ID NO: 9965 - DNA, 32 bp, Homo sapiens
gaggcaacgggcggcaggttgcagtggagggg

SEQ ID NO: 9966 - DNA, 32 bp, Homo sapiens
agcctcctgagtagctgggattacagcacccg

SEQ ID NO: 9967 - DNA, 32 bp, Homo sapiens
gagctgaatttacttggctcccattagaaact

SEQ ID NO: 9968 - DNA, 32 bp, Homo sapiens
gtctcaaactcctgggctcaagcaatcctccc

SEQ ID NO: 9969 - DNA, 32 bp, Homo sapiens
ttgcctcacatggttcaacaccaccttatact

SEQ ID NO: 9970 - DNA, 32 bp, Homo sapiens
cattccctcagtgcttctcttctgacctgcat

SEQ ID NO: 9971 - DNA, 29 bp, Homo sapiens
tgccatgtctctctccccatgccgggccc

SEQ ID NO: 9972 - DNA, 32 bp, Homo sapiens
gcatctgcccacgatggcagtgcagtcatcat

SEQ ID NO: 9973 - DNA, 32 bp, Homo sapiens
gaagagaaagagatcaggcaacagtgattcta

SEQ ID NO: 9974 - DNA, 32 bp, Homo sapiens
tcttgcgggaggcgtgggctgggattgcggtg

SEQ ID NO: 9975 - DNA, 32 bp, Homo sapiens
ccttttcaatattctaatctttgctttgctga

SEQ ID NO: 9976 - DNA, 32 bp, Homo sapiens
acaccaagcaccctgaatcgagactgcaggag

SEQ ID NO: 9977 - DNA, 31 bp, Homo sapiens
acaggaagaacacctctgaggagggattccc

SEQ ID NO: 9978 - DNA, 32 bp, Homo sapiens
cttataagaagaggagattaggtcacagacat

SEQ ID NO: 9979 - DNA, 32 bp, Homo sapiens
tgtagagcattccctgcgatgtggaaaattct

SEQ ID NO: 9980 - DNA, 32 bp, Homo sapiens
gcgtgtccccttctgtcagacagcttcacaga

SEQ ID NO: 9981 - DNA, 32 bp, Homo sapiens
aacgttttggagattgtgcttgttgctttgct

SEQ ID NO: 9982 - DNA, 21 bp, Homo sapiens
caggtcgttggagactgaaga

SEQ ID NO: 9983 - DNA, 32 bp, Homo sapiens
catgtcgggaggctgaggtgggaggatcgctt

SEQ ID NO: 9984 - DNA, 19 bp, Homo sapiens
ggaggcttccttccagccc

SEQ ID NO: 9985 - DNA, 32 bp, Homo sapiens
cccacaaccaaaacaaccccttttaaaagagt

SEQ ID NO: 9986 - DNA, 32 bp, Homo sapiens
tcctgcccaagtgacagctgcggcagcccctc

SEQ ID NO: 9987 - DNA, 32 bp, Homo sapiens
actcttatgcccacgctggagtgcagtgagcc

SEQ ID NO: 9988 - DNA, 32 bp, Homo sapiens
ctggtgtcacccaggctggagtgcagtggtgt

SEQ ID NO: 9989 - DNA, 22 bp, Homo sapiens
caacaccagagaccaggatcca

SEQ ID NO: 9990 - DNA, 32 bp, Homo sapiens
gaacccaggaggtggagcttgcagtgagccga

SEQ ID NO: 9991 - DNA, 32 bp, Homo sapiens
gaacccgggaggtggagcttgcagtgagccaa

SEQ ID NO: 9992 - DNA, 28 bp, Homo sapiens
ggggaactaagtgctgactagtttgttt

SEQ ID NO: 9993 - DNA, 32 bp, Homo sapiens
catctactgcgtgcccttgccaaacagctgtg

SEQ ID NO: 9994 - DNA, 32 bp, Homo sapiens
gaactcaggaggcggagcttgcagtgagccga

SEQ ID NO: 9995 - DNA, 32 bp, Homo sapiens
agcctcctgagtagctgggactacaggcgcct

SEQ ID NO: 9996 - DNA, 32 bp, Homo sapiens
agactcctgagtagctgggattacaggcatgt

SEQ ID NO: 9997 - DNA, 32 bp, Homo sapiens
gaatcactccagacaggaaattttctattttt

SEQ ID NO: 9998 - DNA, 32 bp, Homo sapiens
ctgtgctcaagcaattctcctgcctcagcttc

SEQ ID NO: 9999 - DNA, 32 bp, Homo sapiens
ctgtggagccaggcagcctccacctcacaaga

SEQ ID NO: 10000 - DNA, 32 bp, Homo sapiens
ctaggttcaagcaattctcctgcctcagctac

SEQ ID NO: 10001 - DNA, 32 bp, Homo sapiens
gctctctctagctccccaattctgcctgcctc

SEQ ID NO: 10002 - DNA, 32 bp, Homo sapiens
tgttggccatgtctccccaactccacaatatc

SEQ ID NO: 10003 - DNA, 32 bp, Homo sapiens
actggctcaagcaatctgcccacctcggtctc

SEQ ID NO: 10004 - DNA, 32 bp, Homo sapiens
atggaattgcccagccagtcacagcagtagct

SEQ ID NO: 10005 - DNA, 32 bp, Homo sapiens
actctgtcacccaggctggactgcaatgacgc

SEQ ID NO: 10006 - DNA, 32 bp, Homo sapiens
gggtgtgtgctgcgttcacaggtgtttctgcg

SEQ ID NO: 10007 - DNA, 32 bp, Homo sapiens
ttgcaagaccaccagctcctggaagctgagtt

SEQ ID NO: 10008 - DNA, 28 bp, Homo sapiens
tctggccccggtgctgcctgcatgccaa

SEQ ID NO: 10009 - DNA, 32 bp, Homo sapiens
tgcggagccatcctgaggctttgacatctatg

SEQ ID NO: 10010 - DNA, 32 bp, Homo sapiens
cgttctgtcgcttagctggagtgcggtggcgt

SEQ ID NO: 10011 - DNA, 32 bp, Homo sapiens
ctttctgctggggatggccactgtgaataact

SEQ ID NO: 10012 - DNA, 32 bp, Homo sapiens
agcctccagagtagctgggattacaggcacct

SEQ ID NO: 10013 - DNA, 32 bp, Homo sapiens
agaaccgggaggcggaagttgcagtgagccaa

SEQ ID NO: 10014 - DNA, 32 bp, Homo sapiens
cgacccgggaggctgtgggttggaagctgagc

SEQ ID NO: 10015 - DNA, 32 bp, Homo sapiens
catttgcttttgtaattcttaatgagcaatat

SEQ ID NO: 10016 - DNA, 20 bp, Homo sapiens
ggtgccaccaggcccaggga

SEQ ID NO: 10017 - DNA, 32 bp, Homo sapiens
ccaacctcaagcaatcctcctgcctcagcctc

SEQ ID NO: 10018 - DNA, 32 bp, Homo sapiens
ctatcccagaggtcgaggctgcagtgagctgt

SEQ ID NO: 10019 - DNA, 32 bp, Homo sapiens
ctgtaggcctggagctctcttctggcctggta

SEQ ID NO: 10020 - DNA, 32 bp, Homo sapiens
catcgtgcatcactctcccttctgcctccttc

SEQ ID NO: 10021 - DNA, 32 bp, Homo sapiens
cctctcggcggcctctccaggtgcaaaacttc

SEQ ID NO: 10022 - DNA, 32 bp, Homo sapiens
acctcagtgctgctggactcagttccaagatc

SEQ ID NO: 10023 - DNA, 32 bp, Homo sapiens
gacatcaagggtgcgtcacagccacagtgagg

SEQ ID NO: 10024 - DNA, 32 bp, Homo sapiens
ggaatgtctgcagcttcactcctgaagccagc

SEQ ID NO: 10025 - DNA, 32 bp, Homo sapiens
gttcttagtctctttccatctgtgtcttggct

SEQ ID NO: 10026 - DNA, 32 bp, Homo sapiens
gccagtgaatgacaggctttgaggagcttctc

SEQ ID NO: 10027 - DNA, 28 bp, Homo sapiens
gagctgccccgtgctgccttctccaggc

SEQ ID NO: 10028 - DNA, 32 bp, Homo sapiens
gaactcagaaggcagaggttgcagtggaaaaa

SEQ ID NO: 10029 - DNA, 32 bp, Homo sapiens
ataaagtgattagttgaactggcatcctgctt

SEQ ID NO: 10030 - DNA, 32 bp, Homo sapiens
gatcttaatttaaaagacagaggctccaaaat

SEQ ID NO: 10031 - DNA, 32 bp, Homo sapiens
tgcaggctgggtagctggtagaaatgttgtgg

SEQ ID NO: 10032 - DNA, 32 bp, Homo sapiens
cacctcttgccaggctgcagagctatgcagtc

SEQ ID NO: 10033 - DNA, 32 bp, Homo sapiens
cagccccaaatgccctggattatatgattttt

SEQ ID NO: 10034 - DNA, 32 bp, Homo sapiens
tggacaccttcgtctccatctggtggtccagc

SEQ ID NO: 10035 - DNA, 24 bp, Homo sapiens
tcacacctctaatcccagcacttt

SEQ ID NO: 10036 - DNA, 32 bp, Homo sapiens
tccaactccaacacttaacacagggccaatga

SEQ ID NO: 10037 - DNA, 32 bp, Homo sapiens
aaagaatgaatttctttcaagagaactaattg

SEQ ID NO: 10038 - DNA, 32 bp, Homo sapiens
tcctgccctcaaggcacttacagtccagtttc

SEQ ID NO: 10039 - DNA, 32 bp, Homo sapiens
caggcccgtgtccagtcatacctagagatttg

SEQ ID NO: 10040 - DNA, 21 bp, Homo sapiens
caggaaagtggtctccagccc

SEQ ID NO: 10041 - DNA, 32 bp, Homo sapiens
aaccacctcctggctggacacagggcaagttg

SEQ ID NO: 10042 - DNA, 32 bp, Homo sapiens
gagccggggaggtggaggctgcagtgaactga

SEQ ID NO: 10043 - DNA, 32 bp, Homo sapiens
tgtgacagcggggatggatgtgaccttgcccg

SEQ ID NO: 10044 - DNA, 32 bp, Homo sapiens
ccgggttcaagcgattctcccatctcagcctc

SEQ ID NO: 10045 - DNA, 32 bp, Homo sapiens
agagatggggttgaaacccccatgttggccag

SEQ ID NO: 10046 - DNA, 32 bp, Homo sapiens
ttcacaatgtgaccccgctcccatgggctccc

SEQ ID NO: 10047 - DNA, 23 bp, Homo sapiens
tggcaggatctcagatcactgca

SEQ ID NO: 10048 - DNA, 20 bp, Homo sapiens
tgggatctcgcctcactgca

SEQ ID NO: 10049 - DNA, 32 bp, Homo sapiens
tttcagcctgtctgtctcagggtgcagcctta

SEQ ID NO: 10050 - DNA, 32 bp, Homo sapiens
cttttgttgcgcaggctggagtgcaatggtgc

SEQ ID NO: 10051 - DNA, 32 bp, Homo sapiens
atttgagatgcagaggaatgagcttgagcctt

SEQ ID NO: 10052 - DNA, 32 bp, Homo sapiens
ttaagcaggtaaagcagtcactgtgaagaaaa

SEQ ID NO: 10053 - DNA, 32 bp, Homo sapiens
aacagccagatcctgaatgttctatgttcacc

SEQ ID NO: 10054 - DNA, 25 bp, Homo sapiens
atgcttgaaccccaggcttcagact

SEQ ID NO: 10055 - DNA, 32 bp, Homo sapiens
agagggagggagagagaaagacgaagggagag

SEQ ID NO: 10056 - DNA, 32 bp, Homo sapiens
cgctaggggcctgggagccctgtggctggatc

SEQ ID NO: 10057 - DNA, 32 bp, Homo sapiens
gaacccgggaggtggaggttgccgtgagctga

SEQ ID NO: 10058 - DNA, 32 bp, Homo sapiens
ttgagcctttagggagcttctctgttttggga

SEQ ID NO: 10059 - DNA, 32 bp, Homo sapiens
ggaaattgtcttctcctcagcccgttcgctgg

SEQ ID NO: 10060 - DNA, 22 bp, Homo sapiens
tgagatcgtgggtcacaggccc

SEQ ID NO: 10061 - DNA, 32 bp, Homo sapiens
actgtgatgccgagggtggagtgcagtggcac

SEQ ID NO: 10062 - DNA, 32 bp, Homo sapiens
caaaagtacgaacttagcaacactatattgag

SEQ ID NO: 10063 - DNA, 32 bp, Homo sapiens
attcataattattcagctctgctgctaaacac

SEQ ID NO: 10064 - DNA, 32 bp, Homo sapiens
gccctgcccttggatttgagatcatgtccatc

SEQ ID NO: 10065 - DNA, 32 bp, Homo sapiens
gaacctgggaggtcaagattgcagtgagctat

SEQ ID NO: 10066 - DNA, 32 bp, Homo sapiens
tgtcctgcctccatgctgtcccttctcagcac

SEQ ID NO: 10067 - DNA, 32 bp, Homo sapiens
ctctgttgcccaggctgaggtacagtggcgtg

SEQ ID NO: 10068 - DNA, 32 bp, Homo sapiens
acccccgcctcctgggttcaagcgattctcct

SEQ ID NO: 10069 - DNA, 28 bp, Homo sapiens
tgtgggcctaaatttgcctcattcagac

SEQ ID NO: 10070 - DNA, 32 bp, Homo sapiens
ccaggttcaagcaattctcctgcctcggcctc

SEQ ID NO: 10071 - DNA, 32 bp, Homo sapiens
ctgggttcaagcaattctcctgccttagcctc

SEQ ID NO: 10072 - DNA, 32 bp, Homo sapiens
gtgagggcgcctgggagctgatgggttaagcc

SEQ ID NO: 10073 - DNA, 32 bp, Homo sapiens
gaagaagaagaggaagaaagaacagtagaaaa

SEQ ID NO: 10074 - DNA, 32 bp, Homo sapiens
agggggaggagaggagaaagggaggaagctgg

SEQ ID NO: 10075 - DNA, 32 bp, Homo sapiens
ccgggttcaagcaattctcctgcctcagcctc

SEQ ID NO: 10076 - DNA, 24 bp, Homo sapiens
tcaggcaggtaatcccagaacttt

SEQ ID NO: 10077 - DNA, 23 bp, Homo sapiens
tgtgcctgtaatcccagaacttt

SEQ ID NO: 10078 - DNA, 32 bp, Homo sapiens
tttgtaagtaagtaagaaagaaggcaaattga

SEQ ID NO: 10079 - DNA, 32 bp, Homo sapiens
ctagccataattcctcccttgtttcgattgcc

SEQ ID NO: 10080 - DNA, 32 bp, Homo sapiens
tttttctcctgacttgaacatagggtgacttt

SEQ ID NO: 10081 - DNA, 32 bp, Homo sapiens
ataacagcctgagacagaggtcccaggagatc

SEQ ID NO: 10082 - DNA, 32 bp, Homo sapiens
ccataagcctccatcgttttctcttttctcct

SEQ ID NO: 10083 - DNA, 32 bp, Homo sapiens
gagctcccaagtgccggccaccgctgtcaggg

SEQ ID NO: 10084 - DNA, 32 bp, Homo sapiens
gtcagccaggctgcccttatcagctgtcccct

SEQ ID NO: 10085 - DNA, 32 bp, Homo sapiens
tctgtttacatcctgatttgtatactatttta

SEQ ID NO: 10086 - DNA, 32 bp, Homo sapiens
ggatagcaacatcagttatgggagctgtgagg

SEQ ID NO: 10087 - DNA, 28 bp, Homo sapiens
ttctgtcctaaagtcgcctcatcttcac

SEQ ID NO: 10088 - DNA, 28 bp, Homo sapiens
ctactcccaggtccagcctcatcatgcc

SEQ ID NO: 10089 - DNA, 32 bp, Homo sapiens
gggtcaagcctgctctgccacagggttggatg

SEQ ID NO: 10090 - DNA, 32 bp, Homo sapiens
cagtcgacttcatgagcttcatttggatttct

SEQ ID NO: 10091 - DNA, 22 bp, Homo sapiens
tcacgcctgtaatcccagaact

SEQ ID NO: 10092 - DNA, 32 bp, Homo sapiens
tccccagggaaaggagaaaagagaaaacaggc

SEQ ID NO: 10093 - DNA, 32 bp, Homo sapiens
accgagtggcagggcggccactgtggcggggc

SEQ ID NO: 10094 - DNA, 23 bp, Homo sapiens
tggtgcgatctcggctctctgca

SEQ ID NO: 10095 - DNA, 32 bp, Homo sapiens
cggggctgaccaggctgggggtccagtgaaac

SEQ ID NO: 10096 - DNA, 32 bp, Homo sapiens
gctctgtcacgaggctggagtgcagtggcccc

SEQ ID NO: 10097 - DNA, 32 bp, Homo sapiens
actggcttgtttgccttaacttgtagtaccag

SEQ ID NO: 10098 - DNA, 32 bp, Homo sapiens
tggagaaagaattgtgccatgaaaaatggaaa

SEQ ID NO: 10099 - DNA, 32 bp, Homo sapiens
ctctgtcgtccaggctggagtgcagtgctgca

SEQ ID NO: 10100 - DNA, 32 bp, Homo sapiens
tctgtggtgctgctcggggatggactccatgc

SEQ ID NO: 10101 - DNA, 32 bp, Homo sapiens
taaatagcctctctccccatttaggagcagcc

SEQ ID NO: 10102 - DNA, 32 bp, Homo sapiens
tgtttcttggataggggccagtgcagtgccat

SEQ ID NO: 10103 - DNA, 32 bp, Homo sapiens
tctctgtcacccaggctagagtgcagtggagc

SEQ ID NO: 10104 - DNA, 32 bp, Homo sapiens
ctctgaaatcagctttggagatgctttcactc

SEQ ID NO: 10105 - DNA, 32 bp, Homo sapiens
tccattgctcatgtcacttgtgcagtgactga

SEQ ID NO: 10106 - DNA, 32 bp, Homo sapiens
tggcctgtgatggatggatgttctgtggtgaa

SEQ ID NO: 10107 - DNA, 32 bp, Homo sapiens
tttctgcgctggacctgctcacctgagcctgc

SEQ ID NO: 10108 - DNA, 32 bp, Homo sapiens
acctctgcttcctaggttcaagtgattctcct

SEQ ID NO: 10109 - DNA, 32 bp, Homo sapiens
ctctgtcacccaggctggagtgcagtagcacg

SEQ ID NO: 10110 - DNA, 32 bp, Homo sapiens
gggcccaggcctgggccagaagctgttgacca

SEQ ID NO: 10111 - DNA, 32 bp, Homo sapiens
gctctgtcaccaggccggagtgcagtggtgtc

SEQ ID NO: 10112 - DNA, 32 bp, Homo sapiens
tactgttgtccaggctggagcgcagttgattg

SEQ ID NO: 10113 - DNA, 20 bp, Homo sapiens
tcatgccgataatcccagca

SEQ ID NO: 10114 - DNA, 21 bp, Homo sapiens
cagccaggccacggagagcag

SEQ ID NO: 10115 - DNA, 20 bp, Homo sapiens
gctctgggctgctccaggga

SEQ ID NO: 10116 - DNA, 16 bp, Homo sapiens
catcttgccaccagaa

SEQ ID NO: 10117 - DNA, 32 bp, Homo sapiens
ttcaggtctccagcttctctgcttctcagctg

SEQ ID NO: 10118 - DNA, 32 bp, Homo sapiens
aatcagcggctcctccccatctcacccccagc

SEQ ID NO: 10119 - DNA, 32 bp, Homo sapiens
aacctggtgcccaggtggaggtgcagtggggg

SEQ ID NO: 10120 - DNA, 32 bp, Homo sapiens
gggaagctgaggcaggtgaattgtttgaacct

SEQ ID NO: 10121 - DNA, 32 bp, Homo sapiens
caaatccatccctctctccctcacagttccag

SEQ ID NO: 10122 - DNA, 32 bp, Homo sapiens
ctttatcacccagactggcgtgcagtggcact

SEQ ID NO: 10123 - DNA, 32 bp, Homo sapiens
ctctgttgcccaggctggagtgtagagacaca

SEQ ID NO: 10124 - DNA, 32 bp, Homo sapiens
ctctgttgccctggctggagtacagtggcatg

SEQ ID NO: 10125 - DNA, 32 bp, Homo sapiens
gagcctgggaggcagagattgcactgagccga

SEQ ID NO: 10126 - DNA, 24 bp, Homo sapiens
tcacacctgttatcccagcacttt

SEQ ID NO: 10127 - DNA, 32 bp, Homo sapiens
agcttcccaagtagctgggattacaggcacgt

SEQ ID NO: 10128 - DNA, 32 bp, Homo sapiens
agcctcctgagtagctaggactataggcatgc

SEQ ID NO: 10129 - DNA, 32 bp, Homo sapiens
ttagctgcagaacccacatgtgaatccttgta

SEQ ID NO: 10130 - DNA, 32 bp, Homo sapiens
caagaatctgcagctaacttattttcccctag

SEQ ID NO: 10131 - DNA, 25 bp, Homo sapiens
cgcttgccctctcccggccccggga

SEQ ID NO: 10132 - DNA, 32 bp, Homo sapiens
ctgctcgggaggctgaggcaggagaatcgctt

SEQ ID NO: 10133 - DNA, 32 bp, Homo sapiens
gagtaccacatcctgaccccacttgtttgcaa

SEQ ID NO: 10134 - DNA, 32 bp, Homo sapiens
actagaaaagagacagttcttctgctgacaac

SEQ ID NO: 10135 - DNA, 32 bp, Homo sapiens
agcctcccaagtagctgggattacagtcaggc

SEQ ID NO: 10136 - DNA, 32 bp, Homo sapiens
ctctgttccccaggccggagtgcagtggtacg

SEQ ID NO: 10137 - DNA, 32 bp, Homo sapiens
aaggacccaagtgactctgatgtttacaaagc

SEQ ID NO: 10138 - DNA, 32 bp, Homo sapiens
gagccacgtcttctccacctcggagccccacg

SEQ ID NO: 10139 - DNA, 32 bp, Homo sapiens
cccttcccatttctccccactttcatctacct

SEQ ID NO: 10140 - DNA, 32 bp, Homo sapiens
ttactgagaaaggtgaaatgaaaacaagctca

SEQ ID NO: 10141 - DNA, 32 bp, Homo sapiens
tgcctaagagccttttgaggagaccgtcctgg

SEQ ID NO: 10142 - DNA, 32 bp, Homo sapiens
ggccgccccaaaagagccactttgaccaggct

SEQ ID NO: 10143 - DNA, 32 bp, Homo sapiens
gatttgtttttctgttctcttctgtcctgtct

SEQ ID NO: 10144 - DNA, 32 bp, Homo sapiens
cctgccccaagtgccttgcttttacagtggac

SEQ ID NO: 10145 - DNA, 32 bp, Homo sapiens
tgtgccacctgcagtagtggatcatgtggagt

SEQ ID NO: 10146 - DNA, 32 bp, Homo sapiens
acttgctttgaattcatgttagcaataaatga

SEQ ID NO: 10147 - DNA, 32 bp, Homo sapiens
tatacacccctgagtgaggattacatgcccat

SEQ ID NO: 10148 - DNA, 32 bp, Homo sapiens
tgtctcccaggctgctggagtgcagtggcaca

SEQ ID NO: 10149 - DNA, 32 bp, Homo sapiens
cagtccatcagggacttcctgcagagcgacga

SEQ ID NO: 10150 - DNA, 32 bp, Homo sapiens
ggggcgcatccctcgccacccgcggtcgccca

SEQ ID NO: 10151 - DNA, 22 bp, Homo sapiens
tcacgtctgtaatcccagcgct

SEQ ID NO: 10152 - DNA, 32 bp, Homo sapiens
ccaggtttaagcaattctcatgcttcagccta

SEQ ID NO: 10153 - DNA, 32 bp, Homo sapiens
gctgtgtggcccaggctggagtgcagtggcgc

SEQ ID NO: 10154 - DNA, 21 bp, Homo sapiens
gggccatggtggagggcactt

SEQ ID NO: 10155 - DNA, 32 bp, Homo sapiens
ctcggcctgctgctgctctgcacccccagggc

SEQ ID NO: 10156 - DNA, 32 bp, Homo sapiens
cacagagctggacaggctttgaactcctggat

SEQ ID NO: 10157 - DNA, 32 bp, Homo sapiens
tcttattgcccaggctggagtgcaatggcacg

SEQ ID NO: 10158 - DNA, 32 bp, Homo sapiens
gctgcgtgcgctgcctgctcccgcctgaggaa

SEQ ID NO: 10159 - DNA, 32 bp, Homo sapiens
aaagaactgcctgaattgctgcaatgaaatag

SEQ ID NO: 10160 - DNA, 24 bp, Homo sapiens
tcatgcctataattccagcacttt

SEQ ID NO: 10161 - DNA, 32 bp, Homo sapiens
taaagcaattcattttctcccaccctcggccc

SEQ ID NO: 10162 - DNA, 32 bp, Homo sapiens
tcttgttgcccaagctggagtgcaatggcacg

SEQ ID NO: 10163 - DNA, 24 bp, Homo sapiens
ctgggcaacacagcaagacccatc

SEQ ID NO: 10164 - DNA, 32 bp, Homo sapiens
tgctcatcaaggaggtgctggactacccttgc

SEQ ID NO: 10165 - DNA, 24 bp, Homo sapiens
tcatgtctataatcccagcacttt

SEQ ID NO: 10166 - DNA, 32 bp, Homo sapiens
tttacatatacccagtatctttgcacaaacca

SEQ ID NO: 10167 - DNA, 32 bp, Homo sapiens
ctctgttgcctaggctagggtgcagtggcaca

SEQ ID NO: 10168 - DNA, 32 bp, Homo sapiens
gccacatcagaaagcagaagaaaacagtattt

SEQ ID NO: 10169 - DNA, 32 bp, Homo sapiens
ctgggctcaagcgatcctcccacctcagcttc

SEQ ID NO: 10170 - DNA, 32 bp, Homo sapiens
agcctgccaagtagctggattacaggcacgtg

SEQ ID NO: 10171 - DNA, 22 bp, Homo sapiens
cgccagctctgcagagcccaga

SEQ ID NO: 10172 - DNA, 32 bp, Homo sapiens
catggcagtcattcctggaaggggcaggacct

SEQ ID NO: 10173 - DNA, 32 bp, Homo sapiens
tactcacatcttcattctctaaccactctatt

SEQ ID NO: 10174 - DNA, 32 bp, Homo sapiens
cccgctggtcccaggctggattgccgtggcac

SEQ ID NO: 10175 - DNA, 32 bp, Homo sapiens
tcattgtcacccaggctggagtacagtggcat

SEQ ID NO: 10176 - DNA, 32 bp, Homo sapiens
cagcccgatacttgagcctcctctttaaaagg

SEQ ID NO: 10177 - DNA, 32 bp, Homo sapiens
cctgagctccagtcctgagtttgctacttact

SEQ ID NO: 10178 - DNA, 32 bp, Homo sapiens
gcaggttgcccaggaggagctgcagcgccagc

SEQ ID NO: 10179 - DNA, 32 bp, Homo sapiens
ttctgtcacccaggctggagtgcagtggcgtg

SEQ ID NO: 10180 - DNA, 32 bp, Homo sapiens
attgctcagccaggctgtggagcagctgaggc

SEQ ID NO: 10181 - DNA, 32 bp, Homo sapiens
actgagtgacatcagttagagaggttacctca

SEQ ID NO: 10182 - DNA, 32 bp, Homo sapiens
ctggattcaagcaattctcttgcttcagcctc

SEQ ID NO: 10183 - DNA, 32 bp, Homo sapiens
ctgagctcaagcgatcctcccaccttggccta

SEQ ID NO: 10184 - DNA, 32 bp, Homo sapiens
gactcatgcctgtaatcccagcactttgggag

SEQ ID NO: 10185 - DNA, 32 bp, Homo sapiens
gcctcacagtgacctctccaggcacagctcct

SEQ ID NO: 10186 - DNA, 32 bp, Homo sapiens
gcaccctctgcagccttggtgcctgtagctct

SEQ ID NO: 10187 - DNA, 32 bp, Homo sapiens
cttccacactctgtccccatctggcttctgct

SEQ ID NO: 10188 - DNA, 32 bp, Homo sapiens
aatctgttacccaggctggagtgcagtggtgc

SEQ ID NO: 10189 - DNA, 32 bp, Homo sapiens
gggagtcttgttctgtcacccaggctggagtg

SEQ ID NO: 10190 - DNA, 20 bp, Homo sapiens
tgggatcgcggctcactgca

SEQ ID NO: 10191 - DNA, 32 bp, Homo sapiens
ctagaagagcccaccctttctgatctccaaaa

SEQ ID NO: 10192 - DNA, 32 bp, Homo sapiens
gctctgtcatcaggctggagtgcagtggcgca

SEQ ID NO: 10193 - DNA, 32 bp, Homo sapiens
gctgtacctggatcctgctcctctgggttgaa

SEQ ID NO: 10194 - DNA, 32 bp, Homo sapiens
gcaccgtgccatccctgctcccagctgaggct

SEQ ID NO: 10195 - DNA, 32 bp, Homo sapiens
ccacagcagagctggacgctgtggaaatggct

SEQ ID NO: 10196 - DNA, 32 bp, Homo sapiens
aaccatgggttaacaggaaaggctacctaact

SEQ ID NO: 10197 - DNA, 32 bp, Homo sapiens
gctctgtcaccaggctggagtgcagcggcgca

SEQ ID NO: 10198 - DNA, 32 bp, Homo sapiens
gattacctgtgcagtgcagagcactttaatgc

SEQ ID NO: 10199 - DNA, 32 bp, Homo sapiens
gcctccctgagtggcagggattacaggaaccc

SEQ ID NO: 10200 - DNA, 32 bp, Homo sapiens
tgagttcaagaaagctacctgtggaaaatgga

SEQ ID NO: 10201 - DNA, 23 bp, Homo sapiens
gctcttttgagaattcataattt

SEQ ID NO: 10202 - DNA, 32 bp, Homo sapiens
atttgtaactgcagaagactatcttaaaatac

SEQ ID NO: 10203 - DNA, 32 bp, Homo sapiens
ggcttatgcctgtaatcccagcactttggaag

SEQ ID NO: 10204 - DNA, 32 bp, Homo sapiens
acttcaagagcctgtggtcaggaaatcaggtc

SEQ ID NO: 10205 - DNA, 24 bp, Homo sapiens
tcacgcctgtaatcttagcacttt

SEQ ID NO: 10206 - DNA, 20 bp, Homo sapiens
tcacacctgtaatcccagca

SEQ ID NO: 10207 - DNA, 32 bp, Homo sapiens
aataaagtaattatggaaaatattttaaactc

SEQ ID NO: 10208 - DNA, 24 bp, Homo sapiens
tggcacgatctcagctcattgcag

SEQ ID NO: 10209 - DNA, 18 bp, Homo sapiens
gcaaatgttgatgcctcc

SEQ ID NO: 10210 - DNA, 32 bp, Homo sapiens
tgtcaccaaagtgcccaactctggcacggggc

SEQ ID NO: 10211 - DNA, 32 bp, Homo sapiens
gtcaaatgcccaggcagataggggtgggtacc

SEQ ID NO: 10212 - DNA, 22 bp, Homo sapiens
tcatgcctgtaatcccaacact

SEQ ID NO: 10213 - DNA, 32 bp, Homo sapiens
attggaaggttcatttgagaattctttccttc

SEQ ID NO: 10214 - DNA, 32 bp, Homo sapiens
acctgatggggtagctggggtgtggggttggg

SEQ ID NO: 10215 - DNA, 32 bp, Homo sapiens
gcagtccctgcagctctctttcctctggggca

SEQ ID NO: 10216 - DNA, 32 bp, Homo sapiens
gttgggaaacgttttaacatctggagcctttg

SEQ ID NO: 10217 - DNA, 31 bp, Homo sapiens
aaagaaggcaacacaaattgcaagggagaag

SEQ ID NO: 10218 - DNA, 32 bp, Homo sapiens
ttcttgttgcccaacctggagtgcagtggtgc

SEQ ID NO: 10219 - DNA, 32 bp, Homo sapiens
ggggcagcctctggcttggacagggtctgttt

SEQ ID NO: 10220 - DNA, 32 bp, Homo sapiens
cagccctctcgcttctaacacagggcacctgc

SEQ ID NO: 10221 - DNA, 32 bp, Homo sapiens
ttatttgcctccatggcctttgaacttgcaca

SEQ ID NO: 10222 - DNA, 32 bp, Homo sapiens
gaggtccttcagcctccatctgttctcccacc

SEQ ID NO: 10223 - DNA, 32 bp, Homo sapiens
ccaaccagcaggatgcggctgtggaaggcggt

SEQ ID NO: 10224 - DNA, 32 bp, Homo sapiens
tgttgttgcccaggctggagtgcaatggcgta

SEQ ID NO: 10225 - DNA, 32 bp, Homo sapiens
gtgttcaaggcagacttcctgccccctgcacc

SEQ ID NO: 10226 - DNA, 32 bp, Homo sapiens
ctgaacaattgtggtctctcttaacttgaggt

SEQ ID NO: 10227 - DNA, 24 bp, Homo sapiens
ctgccgcccaaactggagtgcagt

SEQ ID NO: 10228 - DNA, 32 bp, Homo sapiens
agcctcctgagtagctgggattacaggtgtcg

SEQ ID NO: 10229 - DNA, 23 bp, Homo sapiens
ctgttgccaggccagagtgcagt

SEQ ID NO: 10230 - DNA, 23 bp, Homo sapiens
ctgtcaccaggctggagtgcagt

SEQ ID NO: 10231 - DNA, 32 bp, Homo sapiens
ccacggcatcccctccccatctcccctttgtc

SEQ ID NO: 10232 - DNA, 32 bp, Homo sapiens
gctccgtcacccaggctggagtgcagtggcgc

SEQ ID NO: 10233 - DNA, 32 bp, Homo sapiens
actttgttacccaggctggagtgcagtggcac

SEQ ID NO: 10234 - DNA, 23 bp, Homo sapiens
ctgtcgccaggctggagtgcaat

SEQ ID NO: 10235 - DNA, 32 bp, Homo sapiens
tttaccagcttttaaccatctgatatctatag

SEQ ID NO: 10236 - DNA, 32 bp, Homo sapiens
ctgccgcggaggcagcggcggcagcggctctc

SEQ ID NO: 10237 - DNA, 32 bp, Homo sapiens
gagtccgggagtttgagtctgcagtgagctat

SEQ ID NO: 10238 - DNA, 32 bp, Homo sapiens
tattttcagagaattcaggtgctgctggtttt

SEQ ID NO: 10239 - DNA, 32 bp, Homo sapiens
gctgagccaggagtcctctcccagaagttggg

SEQ ID NO: 10240 - DNA, 32 bp, Homo sapiens
atcttttcaagcatgttctaccaccttggaag

SEQ ID NO: 10241 - DNA, 32 bp, Homo sapiens
tttccttcagtaccagtctataagctactgtc

SEQ ID NO: 10242 - DNA, 32 bp, Homo sapiens
cccccagtgctgctgctaaccccacaccaccc

SEQ ID NO: 10243 - DNA, 32 bp, Homo sapiens
gacacggtgctgctgctgcacggcctatcgca

SEQ ID NO: 10244 - DNA, 32 bp, Homo sapiens
gtctcacagcccatgctgaattttctgcattt

SEQ ID NO: 10245 - DNA, 32 bp, Homo sapiens
gcaaagagggcgcaggccctgcagtgacggtt

SEQ ID NO: 10246 - DNA, 32 bp, Homo sapiens
gagaaatgagtgaatgtgggtgatctgctttt

SEQ ID NO: 10247 - DNA, 32 bp, Homo sapiens
acctccacctcctgggttcaagtgattcttgt

SEQ ID NO: 10248 - DNA, 32 bp, Homo sapiens
acctctacctcctgggttcaagcaaatctcct

SEQ ID NO: 10249 - DNA, 32 bp, Homo sapiens
acctctacctcctgggttcaagtgattctcgt

SEQ ID NO: 10250 - DNA, 32 bp, Homo sapiens
agcctcccaagtagctgggattacaggtgctc

SEQ ID NO: 10251 - DNA, 32 bp, Homo sapiens
ggtctcccaaagtgctgggattataggcatga

SEQ ID NO: 10252 - DNA, 32 bp, Homo sapiens
gccgccgcagtccccaggcactacctatgaag

SEQ ID NO: 10253 - DNA, 32 bp, Homo sapiens
acctcaaggagtacaacctggtctggcgcccc

SEQ ID NO: 10254 - DNA, 32 bp, Homo sapiens
acagtgtctgcagctgctgcccttctcccagg

SEQ ID NO: 10255 - DNA, 23 bp, Homo sapiens
tcacgcctgtaatcccagctact

SEQ ID NO: 10256 - DNA, 23 bp, Homo sapiens
gtcacccaggctagagtgcaatg

SEQ ID NO: 10257 - DNA, 23 bp, Homo sapiens
gtcgcccaggctggagtgcggtg

SEQ ID NO: 10258 - DNA, 23 bp, Homo sapiens
gtcacccaggctggagtgcagtg

SEQ ID NO: 10259 - DNA, 32 bp, Homo sapiens
ctcaagccagttcttctcttccagaagaattc

SEQ ID NO: 10260 - DNA, 32 bp, Homo sapiens
gggcctggagcttggcttgtatccaagtgtat

SEQ ID NO: 10261 - DNA, 32 bp, Homo sapiens
gttagggggcttgccttgctctctccagggcc

SEQ ID NO: 10262 - DNA, 32 bp, Homo sapiens
gatagggttcccaggctgcctggagttacata

SEQ ID NO: 10263 - DNA, 32 bp, Homo sapiens
gtagaattgagcaggctggcaatggcagtttt

SEQ ID NO: 10264 - DNA, 32 bp, Homo sapiens
gtcatgttgcccaggctggtctcaggagtcac

SEQ ID NO: 10265 - DNA, 32 bp, Homo sapiens
gaacctgggagcctgaggttgcagtgagccaa

SEQ ID NO: 10266 - DNA, 32 bp, Homo sapiens
gtctgcccaagtgtcttaggaaccaaaagcaa

SEQ ID NO: 10267 - DNA, 32 bp, Homo sapiens
ctacccgggaggctgaggcaggagaattgctt

SEQ ID NO: 10268 - DNA, 32 bp, Homo sapiens
ctgcactagaggcagaggggtgaacaagatac

SEQ ID NO: 10269 - DNA, 32 bp, Homo sapiens
gctttggggatggctggaagtgcaatgtcttc

SEQ ID NO: 10270 - DNA, 32 bp, Homo sapiens
tcttgttatccaggctggggtgcaatggtgcg

SEQ ID NO: 10271 - DNA, 28 bp, Homo sapiens
attaccacagttgctgcctcctccagaa

SEQ ID NO: 10272 - DNA, 32 bp, Homo sapiens
cttgcttcaagggatcctcccacctcagcctc

SEQ ID NO: 10273 - DNA, 32 bp, Homo sapiens
aaacttccgagtagctgggactacaggcatga

SEQ ID NO: 10274 - DNA, 32 bp, Homo sapiens
ttccagaagagactcgggctgtggaaggaaca

SEQ ID NO: 10275 - DNA, 32 bp, Homo sapiens
agacaaaatagaggagagaaagagagcatgag

SEQ ID NO: 10276 - DNA, 22 bp, Homo sapiens
tcacacctgtaatcccagcact

SEQ ID NO: 10277 - DNA, 32 bp, Homo sapiens
cttggctcaaggcatcctcccacctcagcttc

SEQ ID NO: 10278 - DNA, 32 bp, Homo sapiens
tcacccccaagtgtctcccacgactgccctcc

SEQ ID NO: 10279 - DNA, 32 bp, Homo sapiens
agagggagcaggcagagggtgggggacctggc

SEQ ID NO: 10280 - DNA, 32 bp, Homo sapiens
agtcccagaagtaaaccctcactgtgaatcag

SEQ ID NO: 10281 - DNA, 32 bp, Homo sapiens
aggtattcaagtgattctcccatctcggtctc

SEQ ID NO: 10282 - DNA, 32 bp, Homo sapiens
ccaggttcaagcaattctcctacctcagcctc

SEQ ID NO: 10283 - DNA, 32 bp, Homo sapiens
acctccgtctcccaggttcaagcgattcttct

SEQ ID NO: 10284 - DNA, 22 bp, Homo sapiens
tcatgcctgtaatcccagctac

SEQ ID NO: 10285 - DNA, 22 bp, Homo sapiens
gatgaggaagaggactttgggg

SEQ ID NO: 10286 - DNA, 32 bp, Homo sapiens
ccaggttcaagcagttctcctgcctcagcctc

SEQ ID NO: 10287 - DNA, 32 bp, Homo sapiens
tccccagccttctttctctcccagaagcctca

SEQ ID NO: 10288 - DNA, 32 bp, Homo sapiens
gtgacaagcctgggtttctcccaggataggtg

SEQ ID NO: 10289 - DNA, 32 bp, Homo sapiens
attcagcatcttctctattcatgtggagtgaa

SEQ ID NO: 10290 - DNA, 32 bp, Homo sapiens
ttagaattgcccagtgctgccagagtgagtga

SEQ ID NO: 10291 - DNA, 32 bp, Homo sapiens
ctgccccatcattgcacctgcaggcttaggtc

SEQ ID NO: 10292 - DNA, 32 bp, Homo sapiens
ctctgtcacccaggctggagttcagtggtgcg

SEQ ID NO: 10293 - DNA, 32 bp, Homo sapiens
gaatgtaaagagaccaccttcacttgttgaga

SEQ ID NO: 10294 - DNA, 32 bp, Homo sapiens
ctccctctgcgggcttctcttgctctgagcct

SEQ ID NO: 10295 - DNA, 32 bp, Homo sapiens
ccttctcagtttctccccaacctccccttttc

SEQ ID NO: 10296 - DNA, 32 bp, Homo sapiens
ccagtaagaagaggaggaggccaggcaggcaa

SEQ ID NO: 10297 - DNA, 25 bp, Homo sapiens
acaggagtgagccaccacacctggc

SEQ ID NO: 10298 - DNA, 22 bp, Homo sapiens
tccagtggtcacacactggtca

SEQ ID NO: 10299 - DNA, 32 bp, Homo sapiens
atatcacaacccagaagtaaccacctttaaaa

SEQ ID NO: 10300 - DNA, 32 bp, Homo sapiens
ttttataatgttcttgtatagcagctcggtac

SEQ ID NO: 10301 - DNA, 32 bp, Homo sapiens
gtttgggggaagagaaacttgcagtgaaaagg

SEQ ID NO: 10302 - DNA, 32 bp, Homo sapiens
gtcatcatcattgttgtggtgctgctaatggg

SEQ ID NO: 10303 - DNA, 32 bp, Homo sapiens
cagtaaaggtgttccttcctggcagcgtatgc

SEQ ID NO: 10304 - DNA, 20 bp, Homo sapiens
cgcccccgccctgccccagg

SEQ ID NO: 10305 - DNA, 32 bp, Homo sapiens
ctctgtcacctaggctggagtgcagtggcgca

SEQ ID NO: 10306 - DNA, 32 bp, Homo sapiens
ggaaggacgaggcagagctccgcgctgacgaa

SEQ ID NO: 10307 - DNA, 32 bp, Homo sapiens
gccctgttgcccaggctggagtatagtagtgc

SEQ ID NO: 10308 - DNA, 25 bp, Homo sapiens
acaggcacctgccaccacgcctggc

SEQ ID NO: 10309 - DNA, 32 bp, Homo sapiens
ttttgcagcctatatgacttgagattggagct

SEQ ID NO: 10310 - DNA, 32 bp, Homo sapiens
gggcctgggaggtcgaggctgcagtgagctgt

SEQ ID NO: 10311 - DNA, 32 bp, Homo sapiens
gtgaaagggtgatggatttcactgtgaatatg

SEQ ID NO: 10312 - DNA, 32 bp, Homo sapiens
ggttggttgagtagctggtgtttgcatcctgg

SEQ ID NO: 10313 - DNA, 32 bp, Homo sapiens
caggacctagagatgtgcctggaaccactcct

SEQ ID NO: 10314 - DNA, 32 bp, Homo sapiens
cccatctctaagccccttaacctgcagcttcg

SEQ ID NO: 10315 - DNA, 32 bp, Homo sapiens
ttattgaaaagaggaggggaaaggtctataaa

SEQ ID NO: 10316 - DNA, 32 bp, Homo sapiens
ggccgccaccaaggagcagcagctggggcaga

SEQ ID NO: 10317 - DNA, 32 bp, Homo sapiens
gcatctggaagaggaagaagagaggaatgaga

SEQ ID NO: 10318 - DNA, 32 bp, Homo sapiens
gaaccagggaggaggagcttgcagtgagccga

SEQ ID NO: 10319 - DNA, 32 bp, Homo sapiens
ctgtgttggctacaaacctgcaccctgggacc

SEQ ID NO: 10320 - DNA, 32 bp, Homo sapiens
ctacccgcttcctggagcaaacagttgggggt

SEQ ID NO: 10321 - DNA, 32 bp, Homo sapiens
cctagttaagaaaagaggagataatgttcgtc

SEQ ID NO: 10322 - DNA, 32 bp, Homo sapiens
ggaagaggctgctgagaaagagaatgagaaga

SEQ ID NO: 10323 - DNA, 32 bp, Homo sapiens
tattgaaattctaaccctcaatgtgatggtat

SEQ ID NO: 10324 - DNA, 32 bp, Homo sapiens
ttgcaaagtctacattttatgctgaatctgca

SEQ ID NO: 10325 - DNA, 32 bp, Homo sapiens
gttacttagcatttcttaggtgacacaacatt

SEQ ID NO: 10326 - DNA, 19 bp, Homo sapiens
gcccctgcgggtccccagg

SEQ ID NO: 10327 - DNA, 18 bp, Homo sapiens
cagtcggcattgcctgaa

SEQ ID NO: 10328 - DNA, 32 bp, Homo sapiens
gttattgcagaacttcctgtcctggtggagaa

SEQ ID NO: 10329 - DNA, 21 bp, Homo sapiens
gggtctctcctctcccttgca

SEQ ID NO: 10330 - DNA, 32 bp, Homo sapiens
gactaacctcaaggatcctgagtctccttcag

SEQ ID NO: 10331 - DNA, 32 bp, Homo sapiens
gcaggagggttagagtgagtagtaagagatgc

SEQ ID NO: 10332 - DNA, 32 bp, Homo sapiens
aattctaagcctttttgtggctaagttttgtt

SEQ ID NO: 10333 - DNA, 21 bp, Homo sapiens
ttgatgcttatgtagtgcctt

SEQ ID NO: 10334 - DNA, 32 bp, Homo sapiens
gatggatggatggatggatgttggtgaaaatt

SEQ ID NO: 10335 - DNA, 32 bp, Homo sapiens
gcagggaaagagacccggtaattggagggtga

SEQ ID NO: 10336 - DNA, 32 bp, Homo sapiens
agagaaagaggaggagaattaagaagaggatg

SEQ ID NO: 10337 - DNA, 32 bp, Homo sapiens
gtatgtgccaggcactatgctaagcactttac

SEQ ID NO: 10338 - DNA, 32 bp, Homo sapiens
ggagcctgtaccagcctgccttctccaggagg

SEQ ID NO: 10339 - DNA, 18 bp, Homo sapiens
ggcaaatgtcttgcctcc

SEQ ID NO: 10340 - DNA, 32 bp, Homo sapiens
gctgaagaatatgagagacaccaccttttaaa

SEQ ID NO: 10341 - DNA, 24 bp, Homo sapiens
tcatgcctataatacccacacttt

SEQ ID NO: 10342 - DNA, 32 bp, Homo sapiens
gtcgtcaggaggtggaggttgcagtgagccaa

SEQ ID NO: 10343 - DNA, 32 bp, Homo sapiens
tgatctgccctgcactgagcactcagtggata

SEQ ID NO: 10344 - DNA, 32 bp, Homo sapiens
ggcctcccaaagtgctgggattagaggcgtga

SEQ ID NO: 10345 - DNA, 28 bp, Homo sapiens
agaaggcctggtgctgccctggcatcag

SEQ ID NO: 10346 - DNA, 32 bp, Homo sapiens
tagccctccctctcttgggacagacccctcgg

SEQ ID NO: 10347 - DNA, 32 bp, Homo sapiens
cgcgctactgcagctttcttccgccttaggaa

SEQ ID NO: 10348 - DNA, 32 bp, Homo sapiens
tttcagacaagcaattacccagtttccttatc

SEQ ID NO: 10349 - DNA, 32 bp, Homo sapiens
tctctgtcccctaggctgcagtgcagtggcgc

SEQ ID NO: 10350 - DNA, 32 bp, Homo sapiens
atcagttggagtttgtgtctgttgcttgtaat

SEQ ID NO: 10351 - DNA, 32 bp, Homo sapiens
gaaggagctctcttcttgcttggcagctggac

SEQ ID NO: 10352 - DNA, 32 bp, Homo sapiens
ctttgtcacccaggctggagtgcagtggcacg

SEQ ID NO: 10353 - DNA, 32 bp, Homo sapiens
gaacccaggaggtggaggatgcagtgaactga

SEQ ID NO: 10354 - DNA, 32 bp, Homo sapiens
gaagcgcgggacaggcagatgcagtgagtgag

SEQ ID NO: 10355 - DNA, 32 bp, Homo sapiens
cccaggctgccaggctggagtggagtggcatg

SEQ ID NO: 10356 - DNA, 32 bp, Homo sapiens
ctctgtcacctaggctggagtgcagtggcacg

SEQ ID NO: 10357 - DNA, 32 bp, Homo sapiens
ctttgtcgcccaggctggagtgcagtggcaca

SEQ ID NO: 10358 - DNA, 32 bp, Homo sapiens
tcaggctcaagcaaacctctcacctcagcctg

SEQ ID NO: 10359 - DNA, 32 bp, Homo sapiens
ctgggctcaagcaatccacctgcttcagcctt

SEQ ID NO: 10360 - DNA, 24 bp, Homo sapiens
ctgtcgcccaggctgtagtgcaat

SEQ ID NO: 10361 - DNA, 32 bp, Homo sapiens
ggctgccattggaggctgttatctgtgaagaa

SEQ ID NO: 10362 - DNA, 32 bp, Homo sapiens
aaggcttcctgttgtctcagatgcaggagcca

SEQ ID NO: 10363 - DNA, 32 bp, Homo sapiens
ctcctgtcgcccaggctggagtgcaatggcac

SEQ ID NO: 10364 - DNA, 32 bp, Homo sapiens
gtgctccagctttccagtgacatgtgacggcg

SEQ ID NO: 10365 - DNA, 32 bp, Homo sapiens
caaaaatttctggcttctcttacccctattgc

SEQ ID NO: 10366 - DNA, 32 bp, Homo sapiens
gagagccatcttcttaccccctggccacatgg

SEQ ID NO: 10367 - DNA, 32 bp, Homo sapiens
tcggtgctgctgctgctgctcctggggctgct

SEQ ID NO: 10368 - DNA, 17 bp, Homo sapiens
cttggcagctgcagccc

SEQ ID NO: 10369 - DNA, 32 bp, Homo sapiens
gcaagagcctgagaagtttccttgaggtctgt

SEQ ID NO: 10370 - DNA, 32 bp, Homo sapiens
gggaggtggaggctgcaatgagctgagatcat

SEQ ID NO: 10371 - DNA, 32 bp, Homo sapiens
aactcagaggaagaggaaagaaagaagaggag

SEQ ID NO: 10372 - DNA, 32 bp, Homo sapiens
tagtgtttagaacttaggctggaaaaccatat

SEQ ID NO: 10373 - DNA, 32 bp, Homo sapiens
tttacaaatgttctgttttggctgctattggt

SEQ ID NO: 10374 - DNA, 32 bp, Homo sapiens
tgaagacaacatcactctgaagtgttatcagc

SEQ ID NO: 10375 - DNA, 32 bp, Homo sapiens
gaacctgggaggtggagcttgcagtgaaccga

SEQ ID NO: 10376 - DNA, 32 bp, Homo sapiens
cggcccgggaggcggaggcgcgggggaggagg

SEQ ID NO: 10377 - DNA, 32 bp, Homo sapiens
ctttatcctgagtactgggattacaggcgccc

SEQ ID NO: 10378 - DNA, 32 bp, Homo sapiens
gaaggagcatccgtgctgctgtggaaaatatc

SEQ ID NO: 10379 - DNA, 32 bp, Homo sapiens
ttctttgcccagagttgcagttgtactgttgc

SEQ ID NO: 10380 - DNA, 32 bp, Homo sapiens
cacccatatctatcctggattctgaactcttc

SEQ ID NO: 10381 - DNA, 24 bp, Homo sapiens
tcatgcctgtgatccctacacttt

SEQ ID NO: 10382 - DNA, 32 bp, Homo sapiens
agagtactaattcactatgaacacttttgtca

SEQ ID NO: 10383 - DNA, 32 bp, Homo sapiens
agttctgtggtgctgctcggggatggactcca

SEQ ID NO: 10384 - DNA, 32 bp, Homo sapiens
tttacttgagctgtggtcacagctgccaggta

SEQ ID NO: 10385 - DNA, 32 bp, Homo sapiens
tccataaccttctcttctatgacccaacaaca

SEQ ID NO: 10386 - DNA, 32 bp, Homo sapiens
agacacatgtttctccccagcctaagtgtagt

SEQ ID NO: 10387 - DNA, 32 bp, Homo sapiens
cagtgtctgcgtctaagagagcactttgttgc

SEQ ID NO: 10388 - DNA, 28 bp, Homo sapiens
atccccctgcctgctgcctcagtctgca

SEQ ID NO: 10389 - DNA, 32 bp, Homo sapiens
agatgcttccaaggagctacttagttttaggg

SEQ ID NO: 10390 - DNA, 32 bp, Homo sapiens
acgtctgtggcagcttctgtctcgctgggacc

SEQ ID NO: 10391 - DNA, 32 bp, Homo sapiens
aggcaggtgatctgctgcagagcagtaaggga

SEQ ID NO: 10392 - DNA, 19 bp, Homo sapiens
ggccaacatggtgaaaccc

SEQ ID NO: 10393 - DNA, 32 bp, Homo sapiens
agtgagatgagcccgtcctttcacctgcgatc

SEQ ID NO: 10394 - DNA, 32 bp, Homo sapiens
aagggtatctgcccttcttgccaggcagctcc

SEQ ID NO: 10395 - DNA, 32 bp, Homo sapiens
ctttctggggaagcagaactgcagtgacccac

SEQ ID NO: 10396 - DNA, 32 bp, Homo sapiens
ttttaaaaagcagacatctcactgtggtctac

SEQ ID NO: 10397 - DNA, 20 bp, Homo sapiens
gcccctgctttctgcccagg

SEQ ID NO: 10398 - DNA, 32 bp, Homo sapiens
ctcaatttcttaggctggagtgcagtggcacg

SEQ ID NO: 10399 - DNA, 32 bp, Homo sapiens
ctgtgttgtccaggctggagtgcaatggtgtg

SEQ ID NO: 10400 - DNA, 32 bp, Homo sapiens
agcttctgcagggcttctcttgtttacacagc

SEQ ID NO: 10401 - DNA, 32 bp, Homo sapiens
gacctcttgagctcctggaaatagtagaatta

SEQ ID NO: 10402 - DNA, 32 bp, Homo sapiens
ccccttcagcttctccctccggatcgatgtgc

SEQ ID NO: 10403 - DNA, 32 bp, Homo sapiens
cgtccagatacttggagacatctcctcctcac

SEQ ID NO: 10404 - DNA, 32 bp, Homo sapiens
agcatggtgctgctgcttctgctgcttctcca

SEQ ID NO: 10405 - DNA, 32 bp, Homo sapiens
cccccagactttacatgacacagctttatcac

SEQ ID NO: 10406 - DNA, 32 bp, Homo sapiens
gaaccggggagacggaggttgcagtgagccga

SEQ ID NO: 10407 - DNA, 32 bp, Homo sapiens
ctatttcaataacagatggtgctgctaattcc

SEQ ID NO: 10408 - DNA, 32 bp, Homo sapiens
cctatgtttggctgctagaacatggttaccat

SEQ ID NO: 10409 - DNA, 32 bp, Homo sapiens
ccggtttcaagcagttctccagcatcagcctc

SEQ ID NO: 10410 - DNA, 32 bp, Homo sapiens
ctgtctcacccaggctggagtgcagtggcacg

SEQ ID NO: 10411 - DNA, 32 bp, Homo sapiens
atagacccaagtgcatcatgcaagcatatgat

SEQ ID NO: 10412 - DNA, 32 bp, Homo sapiens
gctcacattcaccaaagtttgttttcatgatc

SEQ ID NO: 10413 - DNA, 18 bp, Homo sapiens
gaacctatggacagccca

SEQ ID NO: 10414 - DNA, 32 bp, Homo sapiens
atcggatgcctgcgtgcctcccagaagtgggt

SEQ ID NO: 10415 - DNA, 32 bp, Homo sapiens
gcactgtcacccaggctggagtgcagtggcat

SEQ ID NO: 10416 - DNA, 32 bp, Homo sapiens
gagggaaggagaggagaggaacaggttttgat

SEQ ID NO: 10417 - DNA, 24 bp, Homo sapiens
ctgaccaacatggtgaaacgccat

SEQ ID NO: 10418 - DNA, 32 bp, Homo sapiens
tgaacctgggaggtggagttgcagtgagccga

SEQ ID NO: 10419 - DNA, 32 bp, Homo sapiens
gagcgagggaagttgaggctgcagtgaactat

SEQ ID NO: 10420 - DNA, 28 bp, Homo sapiens
gcaatgggcatcctgaagctgcaagtat

SEQ ID NO: 10421 - DNA, 32 bp, Homo sapiens
ctgtgatgccgagggtggagtgcagtggcaca

SEQ ID NO: 10422 - DNA, 32 bp, Homo sapiens
gcctccttctcctgggtccaagcaattattgt

SEQ ID NO: 10423 - DNA, 32 bp, Homo sapiens
gagcctgggaggtggaggttgcactgagtaga

SEQ ID NO: 10424 - DNA, 32 bp, Homo sapiens
tgagaacagtaatggaaaatggtgttgaagga

SEQ ID NO: 10425 - DNA, 32 bp, Homo sapiens
ttgggttcaagtgattcttccacctcagcctc

SEQ ID NO: 10426 - DNA, 32 bp, Homo sapiens
gaagtcaagaattggggtttggaaaccttcgc

SEQ ID NO: 10427 - DNA, 32 bp, Homo sapiens
ctctgttgcccaggctggagtgcagtggtgcc

SEQ ID NO: 10428 - DNA, 32 bp, Homo sapiens
gtatagtggccatctttggttacttgatattg

SEQ ID NO: 10429 - DNA, 32 bp, Homo sapiens
aatttctagttttcactcatggttaacacgca

SEQ ID NO: 10430 - DNA, 32 bp, Homo sapiens
gaagtccagtgtctgtcatgcccctgagttct

SEQ ID NO: 10431 - DNA, 22 bp, Homo sapiens
ggaacccatgattgttaattca

SEQ ID NO: 10432 - DNA, 32 bp, Homo sapiens
gacctggtgtccctgcatgaggcacagcccga

SEQ ID NO: 10433 - DNA, 32 bp, Homo sapiens
gaacctggaaggcagaagttgcagtgagctga

SEQ ID NO: 10434 - DNA, 32 bp, Homo sapiens
gaacctgggaggcagaggttgtggtgagccaa

SEQ ID NO: 10435 - DNA, 32 bp, Homo sapiens
gaacccaggaggcagaggttgcagtgagccaa

SEQ ID NO: 10436 - DNA, 32 bp, Homo sapiens
gaacccaggaggcagaggttgcggtgagccga

SEQ ID NO: 10437 - DNA, 32 bp, Homo sapiens
gaacccaggagacagaggttgtagtgagctga

SEQ ID NO: 10438 - DNA, 32 bp, Homo sapiens
gaacccgggaggcagaggttgcagtgagccga

SEQ ID NO: 10439 - DNA, 32 bp, Homo sapiens
gaacctgggaggcagaggttgcagtgagctga

SEQ ID NO: 10440 - DNA, 32 bp, Homo sapiens
gaacccgggaggcagaggttgcggtgagccaa

SEQ ID NO: 10441 - DNA, 32 bp, Homo sapiens
aacatttttggtggtctttaatgtgatggaca

SEQ ID NO: 10442 - DNA, 32 bp, Homo sapiens
agcctcttgagtggctgggattgcgggcacat

SEQ ID NO: 10443 - DNA, 32 bp, Homo sapiens
ctctgttgcccaggctgaagtgtagtggcaca

SEQ ID NO: 10444 - DNA, 19 bp, Homo sapiens
gcccaggctagagtgcaat

SEQ ID NO: 10445 - DNA, 24 bp, Homo sapiens
tcatgcctttaatcccagcacttt

SEQ ID NO: 10446 - DNA, 32 bp, Homo sapiens
aacagccagtgtcctcagatggtgctggatct

SEQ ID NO: 10447 - DNA, 32 bp, Homo sapiens
ctgtagggaatccagaaggagcattcatgaag

SEQ ID NO: 10448 - DNA, 32 bp, Homo sapiens
ctctgtcacccaggctgaagtgcagtggagca

SEQ ID NO: 10449 - DNA, 19 bp, Homo sapiens
gcccaggctggagtgcagt

SEQ ID NO: 10450 - DNA, 32 bp, Homo sapiens
aggagagcctccatcctgtcttcatcctcaag

SEQ ID NO: 10451 - DNA, 32 bp, Homo sapiens
cctgagagaccagtgagctcactgtgacccat

SEQ ID NO: 10452 - DNA, 32 bp, Homo sapiens
gcttcccggcctgggtttttagtcttccttgg

SEQ ID NO: 10453 - DNA, 32 bp, Homo sapiens
acttccacctcctgggttgaagcaattcttct

SEQ ID NO: 10454 - DNA, 32 bp, Homo sapiens
gaacctgggaggcggaggttgctgtgagctga

SEQ ID NO: 10455 - DNA, 32 bp, Homo sapiens
aggaggaggggaggagaaggaggaggaagcca

SEQ ID NO: 10456 - DNA, 32 bp, Homo sapiens
ccagactaacttgggcaacacagggcgacccc

SEQ ID NO: 10457 - DNA, 32 bp, Homo sapiens
acagcattgatctcctggaggctggttctgct

SEQ ID NO: 10458 - DNA, 32 bp, Homo sapiens
gctctgttgcctaggctggagtgcagtggcgc

SEQ ID NO: 10459 - DNA, 32 bp, Homo sapiens
gctttgtcgcccaggctggagtgcagtggcgt

SEQ ID NO: 10460 - DNA, 32 bp, Homo sapiens
actttgtcacccaggctggagtatagtggcac

SEQ ID NO: 10461 - DNA, 32 bp, Homo sapiens
gtgcagctgaccagggtttgtgcagtgatctt

SEQ ID NO: 10462 - DNA, 32 bp, Homo sapiens
gaagccaggaggcagaggttgcagtgagccaa

SEQ ID NO: 10463 - DNA, 32 bp, Homo sapiens
agaagggacagacagaggttctcagtgatgag

SEQ ID NO: 10464 - DNA, 32 bp, Homo sapiens
agtcaccctaaaatgcttcacatggttaaaaa

SEQ ID NO: 10465 - DNA, 32 bp, Homo sapiens
cgctctcggaattggccgcggaaaccgatctg

SEQ ID NO: 10466 - DNA, 32 bp, Homo sapiens
ctctgtcacccaagctggagtgcactggcatg

SEQ ID NO: 10467 - DNA, 32 bp, Homo sapiens
cctgtgagtcatggcagctcccatgaatggcc

SEQ ID NO: 10468 - DNA, 15 bp, Homo sapiens
gcccctgcccccggg

SEQ ID NO: 10469 - DNA, 32 bp, Homo sapiens
tccctcgcaagtagctgggattacaggcgcct

SEQ ID NO: 10470 - DNA, 32 bp, Homo sapiens
agcctccggagtagctgggattacaggcatgc

SEQ ID NO: 10471 - DNA, 32 bp, Homo sapiens
aacctccatcttctcccacactgatggcgagc

SEQ ID NO: 10472 - DNA, 31 bp, Homo sapiens
agaatgaacaacacaaccggaagcgggattc

SEQ ID NO: 10473 - DNA, 19 bp, Homo sapiens
gcccctgcctgaaagtgta

SEQ ID NO: 10474 - DNA, 32 bp, Homo sapiens
gagcccaggaggtggaggttgcaatgagccga

SEQ ID NO: 10475 - DNA, 32 bp, Homo sapiens
cttctcgggaggctgaggcaggagaatggcgt

SEQ ID NO: 10476 - DNA, 32 bp, Homo sapiens
gcttcagcctccattctcactttccttctcaa

SEQ ID NO: 10477 - DNA, 32 bp, Homo sapiens
atcttgagtttccaagacctagagagcttggg

SEQ ID NO: 10478 - DNA, 32 bp, Homo sapiens
tggagattcagcaattctgtcttcattgctcc

SEQ ID NO: 10479 - DNA, 32 bp, Homo sapiens
cacaaaatccctgcccttaacaagctcacatt

SEQ ID NO: 10480 - DNA, 32 bp, Homo sapiens
catatgctgctgctgctgcagccaccagagca

SEQ ID NO: 10481 - DNA, 32 bp, Homo sapiens
ctcaggacatgagacatttcctggaagtgatt

SEQ ID NO: 10482 - DNA, 32 bp, Homo sapiens
cctgggcccctctgggcttcagtttccccact

SEQ ID NO: 10483 - DNA, 32 bp, Homo sapiens
aaacccccagttccaaacccgagacttcaggc

SEQ ID NO: 10484 - DNA, 22 bp, Homo sapiens
cggagcctctggggaggcggtc

SEQ ID NO: 10485 - DNA, 32 bp, Homo sapiens
gagattgtgctgctgcactccagcctgggtga

SEQ ID NO: 10486 - DNA, 32 bp, Homo sapiens
tgaacttgggagcagaggtgagctgagtgcag

SEQ ID NO: 10487 - DNA, 32 bp, Homo sapiens
gaacctggaacgcggaggttgcaatgagccga

SEQ ID NO: 10488 - DNA, 32 bp, Homo sapiens
gccctgtcgccaggctggagtgtagtggcatg

SEQ ID NO: 10489 - DNA, 32 bp, Homo sapiens
catcttggaaagcagaggtgtccctgcaggat

SEQ ID NO: 10490 - DNA, 32 bp, Homo sapiens
gaacccgggaggtggaggttgcagtgaggtga

SEQ ID NO: 10491 - DNA, 32 bp, Homo sapiens
gtccgcctcccgggttgacaccattttcctgc

SEQ ID NO: 10492 - DNA, 32 bp, Homo sapiens
gccagcccacagggttcccccacctcagagtt

SEQ ID NO: 10493 - DNA, 32 bp, Homo sapiens
caaaataataacaggctgggtgcaatggctca

SEQ ID NO: 10494 - DNA, 32 bp, Homo sapiens
cagattttcctgttttcgttgttttcaaagac

SEQ ID NO: 10495 - DNA, 32 bp, Homo sapiens
gcgagacggagtttcgtcatgttggccaggcc

SEQ ID NO: 10496 - DNA, 32 bp, Homo sapiens
cttcttggggaccttgaacactggagggtcat

SEQ ID NO: 10497 - DNA, 32 bp, Homo sapiens
caggcaggacaaggagaaagcagggcagaatg

SEQ ID NO: 10498 - DNA, 32 bp, Homo sapiens
gctgtgaggcctggggccttgcactggctgga

SEQ ID NO: 10499 - DNA, 32 bp, Homo sapiens
ttatccagcctatcgttgatggatatttggtt

SEQ ID NO: 10500 - DNA, 32 bp, Homo sapiens
ccgccctggtctcctggaactggtgggccgca

SEQ ID NO: 10501 - DNA, 23 bp, Homo sapiens
gatgaagacttagaatctgtgga

SEQ ID NO: 10502 - DNA, 32 bp, Homo sapiens
tctcagatgctgctgcttgacaatccacacaa

SEQ ID NO: 10503 - DNA, 32 bp, Homo sapiens
aaaagccacttctcttcttcctgagcagatgg

SEQ ID NO: 10504 - DNA, 32 bp, Homo sapiens
cggtccagggcaatgacacacagggtctcgat

SEQ ID NO: 10505 - DNA, 32 bp, Homo sapiens
gctctgtcacccaggctggagtgcagtggagc

SEQ ID NO: 10506 - DNA, 19 bp, Homo sapiens
cagggaagtagtccaggcc

SEQ ID NO: 10507 - DNA, 23 bp, Homo sapiens
tggtgcgatcttgactcacagca

SEQ ID NO: 10508 - DNA, 32 bp, Homo sapiens
ttctgctgcccaagctggagtggcagtggcat

SEQ ID NO: 10509 - DNA, 28 bp, Homo sapiens
gagggattccatgctgccttctccggac

SEQ ID NO: 10510 - DNA, 28 bp, Homo sapiens
aatgttgcaggtgctgcctccgagtctg

SEQ ID NO: 10511 - DNA, 32 bp, Homo sapiens
ctcaatagaagaggaggaaaacatgtttttaa

SEQ ID NO: 10512 - DNA, 32 bp, Homo sapiens
aaatgagtgcaggttgaaagaaaacaggtgaa

SEQ ID NO: 10513 - DNA, 32 bp, Homo sapiens
cacccctcttgcttcttccccacctcaccatc

SEQ ID NO: 10514 - DNA, 15 bp, Homo sapiens
catcgccacccagaa

SEQ ID NO: 10515 - DNA, 32 bp, Homo sapiens
aatgaaagcctctcttcaggctgaaccacaaa

SEQ ID NO: 10516 - DNA, 32 bp, Homo sapiens
atttgctcccgtggagcttcatcggggtggtg

SEQ ID NO: 10517 - DNA, 32 bp, Homo sapiens
cgtcccaggaggcaggcagtggctatgacagt

SEQ ID NO: 10518 - DNA, 32 bp, Homo sapiens
gagcctgggagttcgaggctgcagtgagcaat

SEQ ID NO: 10519 - DNA, 32 bp, Homo sapiens
gccctgtgaaagataggatgtgaggtgagcat

SEQ ID NO: 10520 - DNA, 32 bp, Homo sapiens
tcatcagggccaccccctgcagtattgagcac

SEQ ID NO: 10521 - DNA, 32 bp, Homo sapiens
tctaataatcgggttgggacttaactttaagg

SEQ ID NO: 10522 - DNA, 32 bp, Homo sapiens
ttgttgcttaggatgaggagactctgtaattt

SEQ ID NO: 10523 - DNA, 32 bp, Homo sapiens
gcaaagcaggccatttctcccacctgaaagta

SEQ ID NO: 10524 - DNA, 32 bp, Homo sapiens
ctaacctcgggtgatccacccacctcagcctt

SEQ ID NO: 10525 - DNA, 32 bp, Homo sapiens
ctgttccagcacccttctcccagctgcattcc

SEQ ID NO: 10526 - DNA, 32 bp, Homo sapiens
cacccagagccagtgtggtcagtattccaaac

SEQ ID NO: 10527 - DNA, 32 bp, Homo sapiens
gccaaatccctaactgaacacagatgtctcag

SEQ ID NO: 10528 - DNA, 32 bp, Homo sapiens
cagacagcctgagactgttctcacggaaacac

SEQ ID NO: 10529 - DNA, 32 bp, Homo sapiens
gtcccctactccctggactagtgcagtccttg

SEQ ID NO: 10530 - DNA, 32 bp, Homo sapiens
ttaagtccagttctttgcctcaggggtctcgt

SEQ ID NO: 10531 - DNA, 32 bp, Homo sapiens
tctgatgcagaactttctcttttgaatgttaa

SEQ ID NO: 10532 - DNA, 32 bp, Homo sapiens
gaagcagggataggtgggctgcagtgacatca

SEQ ID NO: 10533 - DNA, 32 bp, Homo sapiens
ccttagggcctaccctggagtgctgcagtgtg

SEQ ID NO: 10534 - DNA, 32 bp, Homo sapiens
ccatgttgcccaggctggtgtcaaactcctgg

SEQ ID NO: 10535 - DNA, 32 bp, Homo sapiens
aaaaatcgaggcaagcctctggaacacagcca

SEQ ID NO: 10536 - DNA, 32 bp, Homo sapiens
cagagtgggaggcagagaagtgtgctcagagg

SEQ ID NO: 10537 - DNA, 32 bp, Homo sapiens
ctgacctcaggtgatccacccacctcggcctc

SEQ ID NO: 10538 - DNA, 32 bp, Homo sapiens
ctggcctcaaatgatccgcccacctcaacctc

SEQ ID NO: 10539 - DNA, 32 bp, Homo sapiens
gcgtttgtcccaggctcgggggctcagtggga

SEQ ID NO: 10540 - DNA, 32 bp, Homo sapiens
agtaagctttatttgtagcttctgccttgttt

SEQ ID NO: 10541 - DNA, 21 bp, Homo sapiens
atgatggttaaactctgtggg

SEQ ID NO: 10542 - DNA, 32 bp, Homo sapiens
tggatgagaagaggagaaaaataaaacaagga

SEQ ID NO: 10543 - DNA, 32 bp, Homo sapiens
ccgctttccccagaggaggagtgcaggcctgc

SEQ ID NO: 10544 - DNA, 32 bp, Homo sapiens
ccactcccagttctgtgttccagaaattgaga

SEQ ID NO: 10545 - DNA, 32 bp, Homo sapiens
cttgcaactcaaataggctatatttcacaata

SEQ ID NO: 10546 - DNA, 32 bp, Homo sapiens
ggaggaggaagaggaggaagaggatgacctga

SEQ ID NO: 10547 - DNA, 32 bp, Homo sapiens
tctgccccatgtgcccttgaagctgccccaca

SEQ ID NO: 10548 - DNA, 32 bp, Homo sapiens
tgacactctgcagactgctagtgttctgtcta

SEQ ID NO: 10549 - DNA, 19 bp, Homo sapiens
tgtggatgtgaggtgggga

SEQ ID NO: 10550 - DNA, 19 bp, Homo sapiens
ccaaaatgaaccagatacc

SEQ ID NO: 10551 - DNA, 32 bp, Homo sapiens
ttcctccagctttcctgagagaaacaggtcaa

SEQ ID NO: 10552 - DNA, 32 bp, Homo sapiens
ctctgcaacagaatatgacaccatcttcccag

SEQ ID NO: 10553 - DNA, 32 bp, Homo sapiens
acacacattgcagcttcaacttttctctttag

SEQ ID NO: 10554 - DNA, 32 bp, Homo sapiens
tgaacccggaagcgaaggttgcagtgagccaa

SEQ ID NO: 10555 - DNA, 32 bp, Homo sapiens
tgcccctgcccaggctgccatgtgagggtgtg

SEQ ID NO: 10556 - DNA, 32 bp, Homo sapiens
aataaatggtgtgatggatggaactaactgga

SEQ ID NO: 10557 - DNA, 32 bp, Homo sapiens
gagagaacaggaggtgaaagaaaagggtgagt

SEQ ID NO: 10558 - DNA, 32 bp, Homo sapiens
ctgagctaaagcgatctgcccacctcggcctc

SEQ ID NO: 10559 - DNA, 32 bp, Homo sapiens
aaacccgggaggtgaaggatgcagtgagccaa

SEQ ID NO: 10560 - DNA, 32 bp, Homo sapiens
ccacaatctgcagccatcaactgcctctgctg

SEQ ID NO: 10561 - DNA, 32 bp, Homo sapiens
gcaatgcatcttctcccccagatcatcacaga

SEQ ID NO: 10562 - DNA, 32 bp, Homo sapiens
actgagcttcctctccccaggacccgcatggg

SEQ ID NO: 10563 - DNA, 21 bp, Homo sapiens
ctcaaccaactcctttagcat

SEQ ID NO: 10564 - DNA, 32 bp, Homo sapiens
atcagttttatcttttgaaaggcacagtctaa

SEQ ID NO: 10565 - DNA, 32 bp, Homo sapiens
ctcaggtctgcagctgggtcctgcctccttcc

SEQ ID NO: 10566 - DNA, 32 bp, Homo sapiens
agatttgctcccagaccctctgatctccctcc

SEQ ID NO: 10567 - DNA, 32 bp, Homo sapiens
tgaacccggtaggggagcttgcagtgagccca

SEQ ID NO: 10568 - DNA, 32 bp, Homo sapiens
gaactcgggaggtggaggttgcagtcagccaa

SEQ ID NO: 10569 - DNA, 32 bp, Homo sapiens
gaacctgggaggcggaggttgcggtcagctga

SEQ ID NO: 10570 - DNA, 32 bp, Homo sapiens
gcttctatgaggagaccatgtgccgaggtcgt

SEQ ID NO: 10571 - DNA, 32 bp, Homo sapiens
gaacccaggaggcggagcttgcagtgagccga

SEQ ID NO: 10572 - DNA, 32 bp, Homo sapiens
gaacccgggaggcggagcttgcagtgagccaa

SEQ ID NO: 10573 - DNA, 32 bp, Homo sapiens
ttttctaggcctggggacggcttttacttaaa

SEQ ID NO: 10574 - DNA, 32 bp, Homo sapiens
ctctttcacccaggctggagtgcagtggcacg

SEQ ID NO: 10575 - DNA, 32 bp, Homo sapiens
ggcctccaaagttcccttaacacttgcaaagt

SEQ ID NO: 10576 - DNA, 32 bp, Homo sapiens
agcttagtgctgggactagcccagaaacttga

SEQ ID NO: 10577 - DNA, 31 bp, Homo sapiens
gacaatgatttcacaactagagggaagcagt

SEQ ID NO: 10578 - DNA, 21 bp, Homo sapiens
gatggggaagctgctggagga

SEQ ID NO: 10579 - DNA, 32 bp, Homo sapiens
tgctacttgcccaggtagtgatcagtgagagt

SEQ ID NO: 10580 - DNA, 32 bp, Homo sapiens
acaggccatgctcagatggagtgctgtctgga

SEQ ID NO: 10581 - DNA, 32 bp, Homo sapiens
ttgagatggagtttcactgttgttccccaggc

SEQ ID NO: 10582 - DNA, 32 bp, Homo sapiens
cttcgtcggtggcagaggtgggcgtgggtgct

SEQ ID NO: 10583 - DNA, 32 bp, Homo sapiens
gtgggctgtgcaggctggtggcctgggtgcct

SEQ ID NO: 10584 - DNA, 32 bp, Homo sapiens
tcgcaggactgaatgaaggcaaacttcccaac

SEQ ID NO: 10585 - DNA, 32 bp, Homo sapiens
tcgttcaggtgcaattcttcttggtctcagct

SEQ ID NO: 10586 - DNA, 32 bp, Homo sapiens
gctgccaggatggaaactaactacctgaagag

SEQ ID NO: 10587 - DNA, 32 bp, Homo sapiens
ctctgtcacccaggctggagtctagtgtcgtg

SEQ ID NO: 10588 - DNA, 24 bp, Homo sapiens
tcatgcccataatcccagcccttt

SEQ ID NO: 10589 - DNA, 23 bp, Homo sapiens
gatggggaaactgaggcttagga

SEQ ID NO: 10590 - DNA, 32 bp, Homo sapiens
tgtacaattgaattggaaatggtgctagtcag

SEQ ID NO: 10591 - DNA, 32 bp, Homo sapiens
catgtagccctctcatttgattgacagtattt

SEQ ID NO: 10592 - DNA, 32 bp, Homo sapiens
tgctctcctcaagggtatcagacggtcgtagg

SEQ ID NO: 10593 - DNA, 18 bp, Homo sapiens
gcccctgccagctcaggt

SEQ ID NO: 10594 - DNA, 32 bp, Homo sapiens
gctctgtcacctaggctgcagtgcagtggcac

SEQ ID NO: 10595 - DNA, 32 bp, Homo sapiens
tctccctccctctctcatgaggcacagccaag

SEQ ID NO: 10596 - DNA, 32 bp, Homo sapiens
ggccgccatccctcggcgccccgcccggaacc

SEQ ID NO: 10597 - DNA, 28 bp, Homo sapiens
tcagctcctggagctgcctctctgcact

SEQ ID NO: 10598 - DNA, 32 bp, Homo sapiens
aaacacccaagtggcccccaccctcagcccgc

SEQ ID NO: 10599 - DNA, 32 bp, Homo sapiens
ctctgttgctcagtctagggtgcagtgacgtg

SEQ ID NO: 10600 - DNA, 32 bp, Homo sapiens
agatgagtccatttgcctcttctgccttcact

SEQ ID NO: 10601 - DNA, 32 bp, Homo sapiens
ccaggttcaagcaagtcttgtgcctcagttta

SEQ ID NO: 10602 - DNA, 32 bp, Homo sapiens
tcttgttgcccaggcggagtacaatggtggga

SEQ ID NO: 10603 - DNA, 32 bp, Homo sapiens
tccgtagcctgggtgaagtcccagaagctggt

SEQ ID NO: 10604 - DNA, 32 bp, Homo sapiens
ttctttctactctcttctcttccccaaggcct

SEQ ID NO: 10605 - DNA, 32 bp, Homo sapiens
ctctgccccctgctggctcttctgcccaattg

SEQ ID NO: 10606 - DNA, 32 bp, Homo sapiens
aaagagaaagagacattcacttggagggctct

SEQ ID NO: 10607 - DNA, 32 bp, Homo sapiens
gaaccagggaggtagaggttgcagtgagctga

SEQ ID NO: 10608 - DNA, 32 bp, Homo sapiens
tcttagcacatcctctgttctctacctgtcat

SEQ ID NO: 10609 - DNA, 32 bp, Homo sapiens
tactattacatcctggagctgtcgttttattg

SEQ ID NO: 10610 - DNA, 32 bp, Homo sapiens
tgagcatcaacaacaaaaacatttgtatgata

SEQ ID NO: 10611 - DNA, 32 bp, Homo sapiens
gaaccggggaggtggaggttgcagtgagctga

SEQ ID NO: 10612 - DNA, 32 bp, Homo sapiens
gaacatgggaggcgtagcttgcagtgagctga

SEQ ID NO: 10613 - DNA, 32 bp, Homo sapiens
cttcttggtcttctccttctgggcctcatggc

SEQ ID NO: 10614 - DNA, 21 bp, Homo sapiens
gggcagcctgcagggcagctg

SEQ ID NO: 10615 - DNA, 32 bp, Homo sapiens
ctgagctcaggtgatctgcccacctcggcctc

SEQ ID NO: 10616 - DNA, 32 bp, Homo sapiens
gctctgttgccaaggctggagtgcagtggaac

SEQ ID NO: 10617 - DNA, 32 bp, Homo sapiens
aattcgaggttgctgagcttctctccaaagtc

SEQ ID NO: 10618 - DNA, 32 bp, Homo sapiens
cactgttgcccaggctggagtgcagtggcgtg

SEQ ID NO: 10619 - DNA, 32 bp, Homo sapiens
gaacccaggagacggagcttgcagtgagccga

SEQ ID NO: 10620 - DNA, 32 bp, Homo sapiens
ccgcgctgcccaggccatggactgtgaggtca

SEQ ID NO: 10621 - DNA, 32 bp, Homo sapiens
ctctgtcacctaggctgcagtgcagtggcaca

SEQ ID NO: 10622 - DNA, 32 bp, Homo sapiens
tgtggctgatgtgtctggaaatgatgtagttc

SEQ ID NO: 10623 - DNA, 32 bp, Homo sapiens
tgacagctttatctccccaggagcagcatctc

SEQ ID NO: 10624 - DNA, 32 bp, Homo sapiens
actggcattgttagctggggacatggaagtgg

SEQ ID NO: 10625 - DNA, 32 bp, Homo sapiens
gctctgtcgcccaggttggagtgcagtggtgc

SEQ ID NO: 10626 - DNA, 32 bp, Homo sapiens
gctctgttgcccaggctggagtgtagtggtgt

SEQ ID NO: 10627 - DNA, 21 bp, Homo sapiens
tgtgagaagcagagataggga

SEQ ID NO: 10628 - DNA, 32 bp, Homo sapiens
gttctgtcgtccaggctggagtgcagtggtgt

SEQ ID NO: 10629 - DNA, 32 bp, Homo sapiens
gctctgtcgcccaggctggagtgcagtggtgt

SEQ ID NO: 10630 - DNA, 32 bp, Homo sapiens
actctgttacccaggctggagtgcagtggtgc

SEQ ID NO: 10631 - DNA, 32 bp, Homo sapiens
gctctgttgcccaggctggagtgcagtggtgc

SEQ ID NO: 10632 - DNA, 32 bp, Homo sapiens
actctgtcacccaggctggagtgtagtggtgc

SEQ ID NO: 10633 - DNA, 32 bp, Homo sapiens
actctgtcacccaggctggagtgcagtggtgt

SEQ ID NO: 10634 - DNA, 32 bp, Homo sapiens
gatctggggaggcagaggtgacagtgagctga

SEQ ID NO: 10635 - DNA, 32 bp, Homo sapiens
agtgtgctcatcctgaactgttactccaaatc

SEQ ID NO: 10636 - DNA, 32 bp, Homo sapiens
tgaatttgcccaggtaggcgtgagagtgtggg

SEQ ID NO: 10637 - DNA, 32 bp, Homo sapiens
aaagaaagaaagaaagaaagaaagaaaacagt

SEQ ID NO: 10638 - DNA, 32 bp, Homo sapiens
ctctgttgcccaggctggagtgcggtggactc

SEQ ID NO: 10639 - DNA, 32 bp, Homo sapiens
tctggttgcccaggctggggtacagtggtgga

SEQ ID NO: 10640 - DNA, 32 bp, Homo sapiens
gtcccagtatactcacttatctcatccatgga

SEQ ID NO: 10641 - DNA, 32 bp, Homo sapiens
gttcctgccttctcttctatcctgcaatttct

SEQ ID NO: 10642 - DNA, 32 bp, Homo sapiens
atgttccattggacaaagcaaatcacatggcc

SEQ ID NO: 10643 - DNA, 32 bp, Homo sapiens
tcgctgttgcccaggctagagcgcaggggcac

SEQ ID NO: 10644 - DNA, 32 bp, Homo sapiens
gctctgttgcccaggctggagtgcagggacac

SEQ ID NO: 10645 - DNA, 21 bp, Homo sapiens
ccaacatggcaaaaacccatc

SEQ ID NO: 10646 - DNA, 32 bp, Homo sapiens
ctactcgggaggctgaggtgggaggatcactt

SEQ ID NO: 10647 - DNA, 32 bp, Homo sapiens
catactgctaagtcagctactttgccaagaaa

SEQ ID NO: 10648 - DNA, 32 bp, Homo sapiens
cagcaacatcattaccgctagcggcagttttg

SEQ ID NO: 10649 - DNA, 28 bp, Homo sapiens
gtatgaccaaatcctgcctcattaattc

SEQ ID NO: 10650 - DNA, 19 bp, Homo sapiens
gccaccactgctcccagga

SEQ ID NO: 10651 - DNA, 32 bp, Homo sapiens
gctccctctcaccaccctcttctgcctatgag

SEQ ID NO: 10652 - DNA, 32 bp, Homo sapiens
acccaggcatctgctttactctggaccatagg

SEQ ID NO: 10653 - DNA, 32 bp, Homo sapiens
tcactgtcaccaaggcttagtgcagtgacaca

SEQ ID NO: 10654 - DNA, 32 bp, Homo sapiens
gaacctgggagttggaggttgcagtgaaacga

SEQ ID NO: 10655 - DNA, 32 bp, Homo sapiens
gaacccaggacacggagattgcagtgagccaa

SEQ ID NO: 10656 - DNA, 32 bp, Homo sapiens
taacccaggaggcagaggttgcagtgagctga

SEQ ID NO: 10657 - DNA, 32 bp, Homo sapiens
tccactcaacatcaagataagctgctctatat

SEQ ID NO: 10658 - DNA, 32 bp, Homo sapiens
ctccttctgtgtacctgctcccacttctgagc

SEQ ID NO: 10659 - DNA, 32 bp, Homo sapiens
atactcgggaggctgaggcaggagaatcactt

SEQ ID NO: 10660 - DNA, 32 bp, Homo sapiens
atttagtcacccagaggagccagtaagtgtta

SEQ ID NO: 10661 - DNA, 32 bp, Homo sapiens
cctttatctccaacaatatccacctcaccaaa

SEQ ID NO: 10662 - DNA, 32 bp, Homo sapiens
tagcccctctcaaaaggagtctttattctgag

SEQ ID NO: 10663 - DNA, 21 bp, Homo sapiens
atccacccttatttgctctca

SEQ ID NO: 10664 - DNA, 32 bp, Homo sapiens
ggaagggaaggaggagaaagcaggcgaagcgg

SEQ ID NO: 10665 - DNA, 32 bp, Homo sapiens
agaggaaggagaggagaggggcacagggtctc

SEQ ID NO: 10666 - DNA, 32 bp, Homo sapiens
cacttgtcacccaggctggagtgcagtggctc

SEQ ID NO: 10667 - DNA, 32 bp, Homo sapiens
atctctgcagaacaaccagctggaaaagatct

SEQ ID NO: 10668 - DNA, 32 bp, Homo sapiens
cgtgtatattttctcccccaatgactcaattg

SEQ ID NO: 10669 - DNA, 32 bp, Homo sapiens
ttggggaaagagacctttaaaatcttgtggtg

SEQ ID NO: 10670 - DNA, 32 bp, Homo sapiens
cctttcttgtgaccatctccccatgaaagtgc

SEQ ID NO: 10671 - DNA, 28 bp, Homo sapiens
tgtcccacaactctggcctcatcgccct

SEQ ID NO: 10672 - DNA, 32 bp, Homo sapiens
gaaccaaggaggtggaggttgcagtgagccgg

SEQ ID NO: 10673 - DNA, 32 bp, Homo sapiens
ctccttctctgtgagctgtcagtctaggttat

SEQ ID NO: 10674 - DNA, 32 bp, Homo sapiens
tttgttaaggttcaagacagatgggcatatgt

SEQ ID NO: 10675 - DNA, 32 bp, Homo sapiens
ccaggttcaagcaattttcctgcttcagcttc

SEQ ID NO: 10676 - DNA, 32 bp, Homo sapiens
aaaatctgtctcaggctggtagttagcagttg

SEQ ID NO: 10677 - DNA, 32 bp, Homo sapiens
gagccacagccagcagtagtcctcattcaaca

SEQ ID NO: 10678 - DNA, 32 bp, Homo sapiens
ctttttcttcaaggagcactagctgctgggga

SEQ ID NO: 10679 - DNA, 32 bp, Homo sapiens
tcttgtcgcccaggctggagtgcaatggcgca

SEQ ID NO: 10680 - DNA, 32 bp, Homo sapiens
aaagcagtctgtattccatcatcttccttttt

SEQ ID NO: 10681 - DNA, 32 bp, Homo sapiens
cagacaagtttccaagagtggaacatggtgtc

SEQ ID NO: 10682 - DNA, 32 bp, Homo sapiens
gggaatctcagtagctgggaattatggaaaaa

SEQ ID NO: 10683 - DNA, 32 bp, Homo sapiens
tcttgtcacccaggctggagtgcaatggcgcg

SEQ ID NO: 10684 - DNA, 32 bp, Homo sapiens
tccccaaccccaaatcaagaccacctttcttc

SEQ ID NO: 10685 - DNA, 32 bp, Homo sapiens
gcctctccgaatctctctcttctcctggcgct

SEQ ID NO: 10686 - DNA, 32 bp, Homo sapiens
acccattttcacattcccatctgtcaccaatt

SEQ ID NO: 10687 - DNA, 32 bp, Homo sapiens
cctgtggtgctgctgggccctcccactccatc

SEQ ID NO: 10688 - DNA, 32 bp, Homo sapiens
aagaatgcctgagacgcccccagggaataagg

SEQ ID NO: 10689 - DNA, 32 bp, Homo sapiens
atctggaagcctttctggattaatccagtgat

SEQ ID NO: 10690 - DNA, 32 bp, Homo sapiens
ctgcagaaaggagctacccactgtgggtcttc

SEQ ID NO: 10691 - DNA, 23 bp, Homo sapiens
tggcatgatcttggctcactgca

SEQ ID NO: 10692 - DNA, 23 bp, Homo sapiens
tggcatgatctcggctcaccgca

SEQ ID NO: 10693 - DNA, 32 bp, Homo sapiens
gcccctgcctccatttctcgctctctgtccac

SEQ ID NO: 10694 - DNA, 32 bp, Homo sapiens
agcctcctgagtagctgggattacaggcatga

SEQ ID NO: 10695 - DNA, 32 bp, Homo sapiens
ctgctgaggaaggataggctgtggaaattagg

SEQ ID NO: 10696 - DNA, 32 bp, Homo sapiens
gggcgtgggaggcagaagacactgaagaattt

SEQ ID NO: 10697 - DNA, 32 bp, Homo sapiens
cagtgaagtataatcagcactttgccatgctc

SEQ ID NO: 10698 - DNA, 32 bp, Homo sapiens
agcctcctgagtagctgggactgcaggcacgc

SEQ ID NO: 10699 - DNA, 32 bp, Homo sapiens
agcctcctgagtagctgggactacaggcacac

SEQ ID NO: 10700 - DNA, 18 bp, Homo sapiens
ccttctctgccacccgaa

SEQ ID NO: 10701 - DNA, 32 bp, Homo sapiens
tccctctgcttcttttctcttctgccctcctt

SEQ ID NO: 10702 - DNA, 32 bp, Homo sapiens
tttgctacacttctccccacctggtacatgat

SEQ ID NO: 10703 - DNA, 32 bp, Homo sapiens
actctgttgcccaggctggactacagtggcac

SEQ ID NO: 10704 - DNA, 32 bp, Homo sapiens
tttctctgtgcccttttgacagctccagggat

SEQ ID NO: 10705 - DNA, 19 bp, Homo sapiens
ccatcactacttttcagaa

SEQ ID NO: 10706 - DNA, 32 bp, Homo sapiens
gaacattccagatgtgtgagatcatgtgtatt

SEQ ID NO: 10707 - DNA, 32 bp, Homo sapiens
ggttgggggaggcagaggtggcactggaggcc

SEQ ID NO: 10708 - DNA, 32 bp, Homo sapiens
ttctgttgcccatgctggagtgcagtggcgtg

SEQ ID NO: 10709 - DNA, 32 bp, Homo sapiens
ctctgttgcccaggctggagtgcagtggcgcc

SEQ ID NO: 10710 - DNA, 32 bp, Homo sapiens
gtcttgaactcctgagttcaagcgatccacct

SEQ ID NO: 10711 - DNA, 32 bp, Homo sapiens
ctgacctcaagcgatccacccacctcggcctc

SEQ ID NO: 10712 - DNA, 32 bp, Homo sapiens
ctgggctcaagcaattcatctgcctcaacctc

SEQ ID NO: 10713 - DNA, 32 bp, Homo sapiens
tagagggctcctgggagcgctcgcttctccgt

SEQ ID NO: 10714 - DNA, 32 bp, Homo sapiens
gaaagtcttcgagaagcttcagaggagggaag

SEQ ID NO: 10715 - DNA, 23 bp, Homo sapiens
catgcctgtaaatccagcacttt

SEQ ID NO: 10716 - DNA, 32 bp, Homo sapiens
ctctcccgtacctcagaagagtgcagtactgg

SEQ ID NO: 10717 - DNA, 32 bp, Homo sapiens
tcttgccaggaggaggaatgagagtgatgttg

SEQ ID NO: 10718 - DNA, 32 bp, Homo sapiens
aatggaccagttctgttctccaaagactgcag

SEQ ID NO: 10719 - DNA, 20 bp, Homo sapiens
gcccagctggccacctagaa

SEQ ID NO: 10720 - DNA, 32 bp, Homo sapiens
agttgaaggaggcagaagggagagtgatgcac

SEQ ID NO: 10721 - DNA, 32 bp, Homo sapiens
gaacccgggacgcagaggttacagtgaaccga

SEQ ID NO: 10722 - DNA, 32 bp, Homo sapiens
gtagaaaaatggattgggctggcagctcgaag

SEQ ID NO: 10723 - DNA, 32 bp, Homo sapiens
ttctgtcgccctggctggagtgcaatggtgtg

SEQ ID NO: 10724 - DNA, 32 bp, Homo sapiens
ctctgtctcccaggctggagtgtgatggcgtg

SEQ ID NO: 10725 - DNA, 32 bp, Homo sapiens
tgttacccaagtgtcttatacaagcttctggt

SEQ ID NO: 10726 - DNA, 32 bp, Homo sapiens
ctgacctcatgtaatccacccacctcagcctc

SEQ ID NO: 10727 - DNA, 32 bp, Homo sapiens
ggttcacacctgtaattgcagcactttgggag

SEQ ID NO: 10728 - DNA, 32 bp, Homo sapiens
agcctcctgagtagctgggaatacagcatgcg

SEQ ID NO: 10729 - DNA, 32 bp, Homo sapiens
ccgtctcatcttctctcatctgatcacttcat

SEQ ID NO: 10730 - DNA, 29 bp, Homo sapiens
cgatatggaagaggagggcaagaagggca

SEQ ID NO: 10731 - DNA, 32 bp, Homo sapiens
gctctgtcacctagactggaatgtgtggcata

SEQ ID NO: 10732 - DNA, 32 bp, Homo sapiens
gctctgttgcccaggctggtgtgtagtgatct

SEQ ID NO: 10733 - DNA, 18 bp, Homo sapiens
cagggaagctgggagtcc

SEQ ID NO: 10734 - DNA, 32 bp, Homo sapiens
tccaaatcagattcctcaaaccacctttgaaa

SEQ ID NO: 10735 - DNA, 32 bp, Homo sapiens
ttatttaaagagacagtacactctgaaagaac

SEQ ID NO: 10736 - DNA, 32 bp, Homo sapiens
cctcaatccacagtctccaacaacagttaaaa

SEQ ID NO: 10737 - DNA, 32 bp, Homo sapiens
cttcccaggggaacgaggagatctgtgtttac

SEQ ID NO: 10738 - DNA, 32 bp, Homo sapiens
acaacatgcaatctttgtctttgcttctggcc

SEQ ID NO: 10739 - DNA, 32 bp, Homo sapiens
attctaggcagaggctggaatgcaatgatgcg

SEQ ID NO: 10740 - DNA, 32 bp, Homo sapiens
gccctgtgaaccacctgctgccctgtgaggcc

SEQ ID NO: 10741 - DNA, 32 bp, Homo sapiens
acctctgcctcctgggtttaagcaattctcct

SEQ ID NO: 10742 - DNA, 32 bp, Homo sapiens
gctggaggcccgggctggaggggcagtgttgc

SEQ ID NO: 10743 - DNA, 32 bp, Homo sapiens
ctgtattgcccaggctggagtgtggtggcaca

SEQ ID NO: 10744 - DNA, 32 bp, Homo sapiens
tccaggtgccctggctggagtcagtcctcatc

SEQ ID NO: 10745 - DNA, 32 bp, Homo sapiens
tgctaatctcaaggagcttccagtgcagaggg

SEQ ID NO: 10746 - DNA, 32 bp, Homo sapiens
tggtgctctcttctccccactgtgcccgtccg

SEQ ID NO: 10747 - DNA, 32 bp, Homo sapiens
aaagagcatcttctctcccactgcaccccttc

SEQ ID NO: 10748 - DNA, 24 bp, Homo sapiens
tggcacaatctcgactcactgcag

SEQ ID NO: 10749 - DNA, 32 bp, Homo sapiens
cctgtactgctgctgctgctgctcagggcttc

SEQ ID NO: 10750 - DNA, 32 bp, Homo sapiens
gtagctggtgcgctgctcacggccattcactg

SEQ ID NO: 10751 - DNA, 32 bp, Homo sapiens
atgctcccagttctgttaggacaggcatactg

SEQ ID NO: 10752 - DNA, 32 bp, Homo sapiens
tatctggatcagtaataaaatatttcaaaggc

SEQ ID NO: 10753 - DNA, 32 bp, Homo sapiens
ttgtgacggagttttgctcttgtctcccaggc

SEQ ID NO: 10754 - DNA, 32 bp, Homo sapiens
tgttgcatataccttaatctttgatatgaata

SEQ ID NO: 10755 - DNA, 32 bp, Homo sapiens
gaatggatttatgctgtcttagcaatatgaca

SEQ ID NO: 10756 - DNA, 32 bp, Homo sapiens
agtctgttggcagactggagtgcaatcatggc

SEQ ID NO: 10757 - DNA, 28 bp, Homo sapiens
accatcttaagagatgcctcattttaga

SEQ ID NO: 10758 - DNA, 32 bp, Homo sapiens
gagcccaggagtttgaggttgcagtgagctga

SEQ ID NO: 10759 - DNA, 32 bp, Homo sapiens
tgagagaacaactgtctgctgtggaaagtaac

SEQ ID NO: 10760 - DNA, 32 bp, Homo sapiens
atgccagcgtcaacaggaggctgtctggacac

SEQ ID NO: 10761 - DNA, 32 bp, Homo sapiens
taaaatttaatcacaggaaactacttatatct

SEQ ID NO: 10762 - DNA, 32 bp, Homo sapiens
ctctcccatcttctcatatcctggctcttctc

SEQ ID NO: 10763 - DNA, 31 bp, Homo sapiens
ccctcttagcacaggtctaggagggaaaaat

SEQ ID NO: 10764 - DNA, 32 bp, Homo sapiens
gccctttatttatgcaaaaccacctcagaatc

SEQ ID NO: 10765 - DNA, 32 bp, Homo sapiens
ggccctgtgctgcctgcctcatagtatctgcc

SEQ ID NO: 10766 - DNA, 32 bp, Homo sapiens
ttattgcttaaaacatgaagactgctttcttt

SEQ ID NO: 10767 - DNA, 32 bp, Homo sapiens
agaaataatcccaagtcacaccaccttctatt

SEQ ID NO: 10768 - DNA, 21 bp, Homo sapiens
ctgaccaacatggtgaaatcc

SEQ ID NO: 10769 - DNA, 21 bp, Homo sapiens
ctgaccaacacggtgaaaccc

SEQ ID NO: 10770 - DNA, 32 bp, Homo sapiens
ttgagatggagtttggctgttgtctcccaggc

SEQ ID NO: 10771 - DNA, 23 bp, Homo sapiens
tcatgcctgtaatccctgcactt

SEQ ID NO: 10772 - DNA, 32 bp, Homo sapiens
cctaggggaagaggagaagagggtaagggggc

SEQ ID NO: 10773 - DNA, 32 bp, Homo sapiens
ccaggctggtctcaaacccccagcctcaactg

SEQ ID NO: 10774 - DNA, 32 bp, Homo sapiens
ttaagagacagagtttcgcttgttgcccaggc

SEQ ID NO: 10775 - DNA, 19 bp, Homo sapiens
cgcccgggctgggcactaa

SEQ ID NO: 10776 - DNA, 32 bp, Homo sapiens
ctgttgttggagacatgacaatcattttcatc

SEQ ID NO: 10777 - DNA, 32 bp, Homo sapiens
atacagtactcagttaggcagtgcagtactca

SEQ ID NO: 10778 - DNA, 32 bp, Homo sapiens
gctctgtcgtccaggctggagtgcagtgctgc

SEQ ID NO: 10779 - DNA, 32 bp, Homo sapiens
tagagatggagtttcaccatgttggccaggct

SEQ ID NO: 10780 - DNA, 32 bp, Homo sapiens
gatcctaaaagtgcccttggctgcctgctgga

SEQ ID NO: 10781 - DNA, 32 bp, Homo sapiens
gctgtgagagattctttcaagaagaccaaaat

SEQ ID NO: 10782 - DNA, 32 bp, Homo sapiens
actgcccctctctgggcttcagtttcctcctt

SEQ ID NO: 10783 - DNA, 32 bp, Homo sapiens
gcttattgcccaggctggagtgcaatggcacg

SEQ ID NO: 10784 - DNA, 32 bp, Homo sapiens
ccaggccatccctctcgtgtctgtagccagtg

SEQ ID NO: 10785 - DNA, 32 bp, Homo sapiens
gttctctccctctctccttcccagagcaattt

SEQ ID NO: 10786 - DNA, 32 bp, Homo sapiens
gagggccttgtccttgaacactactggggtat

SEQ ID NO: 10787 - DNA, 32 bp, Homo sapiens
atataataagcttttgctgtagattgcctagt

SEQ ID NO: 10788 - DNA, 32 bp, Homo sapiens
tggggaccagggactgattatttgtcacctgg

SEQ ID NO: 10789 - DNA, 32 bp, Homo sapiens
gagggtcgagcagcaggggcccattcagtccc

SEQ ID NO: 10790 - DNA, 32 bp, Homo sapiens
gctctgtcccccaggctggcgtgcagtagcat

SEQ ID NO: 10791 - DNA, 32 bp, Homo sapiens
acactgtcacccaggctggagtgcagtgttgc

SEQ ID NO: 10792 - DNA, 32 bp, Homo sapiens
agcctgagagttaggagaaatatttcagagcc

SEQ ID NO: 10793 - DNA, 32 bp, Homo sapiens
ggagcgggaagaggagatgacaggaagcgacg

SEQ ID NO: 10794 - DNA, 32 bp, Homo sapiens
actacaattgcttgttaaaatattttataagt

SEQ ID NO: 10795 - DNA, 32 bp, Homo sapiens
gctgccagtccctcgttgcaggacagggtcat

SEQ ID NO: 10796 - DNA, 32 bp, Homo sapiens
gcctgctccctctctctgcagaacgggctcat

SEQ ID NO: 10797 - DNA, 32 bp, Homo sapiens
tctaacactcctgggagctcaggaggcttctg

SEQ ID NO: 10798 - DNA, 32 bp, Homo sapiens
gactgaagcacctgctccgccatgaacttgcc

SEQ ID NO: 10799 - DNA, 28 bp, Homo sapiens
ttctgcatagctgctgcctcctaatctt

SEQ ID NO: 10800 - DNA, 32 bp, Homo sapiens
ggaggaactcaagctcagcttctgcctcctgt

SEQ ID NO: 10801 - DNA, 32 bp, Homo sapiens
ctgagtcgcacagtctctcccacccgaatgcc

SEQ ID NO: 10802 - DNA, 32 bp, Homo sapiens
ccccaatctgcggcttctcccacctcactggg

SEQ ID NO: 10803 - DNA, 32 bp, Homo sapiens
tctctgtcacccaggctggagtgcagtggtgt

SEQ ID NO: 10804 - DNA, 32 bp, Homo sapiens
ttccagaggttagaaaacttgcttgaagttcc

SEQ ID NO: 10805 - DNA, 32 bp, Homo sapiens
agctccctgcttggctctgtctctccacaccc

SEQ ID NO: 10806 - DNA, 32 bp, Homo sapiens
tgcctctgtaccatttttccttgagtgtgctt

SEQ ID NO: 10807 - DNA, 32 bp, Homo sapiens
ctattgcttcagaattatgtggagtctgttac

SEQ ID NO: 10808 - DNA, 32 bp, Homo sapiens
agcctcctgagtagctgggaccataggtgtga

SEQ ID NO: 10809 - DNA, 32 bp, Homo sapiens
ctctgtcacctaggctggagtgcagtggtgca

SEQ ID NO: 10810 - DNA, 32 bp, Homo sapiens
gaggatctgcttggtcttgataagctatgttg

SEQ ID NO: 10811 - DNA, 32 bp, Homo sapiens
gttcagactcacctatgtggcaccttaaactt

SEQ ID NO: 10812 - DNA, 32 bp, Homo sapiens
cagataagcccaaagacagcaacttctccact

SEQ ID NO: 10813 - DNA, 32 bp, Homo sapiens
ccgggccttggagatggagaattctcagttgt

SEQ ID NO: 10814 - DNA, 32 bp, Homo sapiens
ttctggatcacgtgggcccagtgcagttcaaa

SEQ ID NO: 10815 - DNA, 32 bp, Homo sapiens
agaaactatcttctcccaacatttactaacat

SEQ ID NO: 10816 - DNA, 23 bp, Homo sapiens
tcacactgtaatgccagcacttt

SEQ ID NO: 10817 - DNA, 28 bp, Homo sapiens
tgctttccctctcctgcctcattccttg

SEQ ID NO: 10818 - DNA, 32 bp, Homo sapiens
tgagccaggaggaggaggttgcagtgagccga

SEQ ID NO: 10819 - DNA, 32 bp, Homo sapiens
cagcagccagcaggctgggggagcagtgaggg

SEQ ID NO: 10820 - DNA, 24 bp, Homo sapiens
ctgtgtcccaggctggagtgcagt

SEQ ID NO: 10821 - DNA, 32 bp, Homo sapiens
aacctccttagtagctgggattacaggcatgt

SEQ ID NO: 10822 - DNA, 32 bp, Homo sapiens
tctggaagtaccacctggactcacagaggagc

SEQ ID NO: 10823 - DNA, 32 bp, Homo sapiens
tgaggaggaagaggaggaggaagaggaggaag

SEQ ID NO: 10824 - DNA, 32 bp, Homo sapiens
caccctggcttccatcatgagtgcagtgtcat

SEQ ID NO: 10825 - DNA, 32 bp, Homo sapiens
cagagttcaagcaattctccttcctcagcctc

SEQ ID NO: 10826 - DNA, 32 bp, Homo sapiens
ttggggttgcccagcctggagcggagcttgcc

SEQ ID NO: 10827 - DNA, 32 bp, Homo sapiens
tggacttttgcagcttccttccaagtcttcct

SEQ ID NO: 10828 - DNA, 18 bp, Homo sapiens
caggctgacgttgcctga

SEQ ID NO: 10829 - DNA, 32 bp, Homo sapiens
agcctcctaagtagctgggattacaggcatgc

SEQ ID NO: 10830 - DNA, 32 bp, Homo sapiens
agcctaccaagtagctgggaccatgggtgtgt

SEQ ID NO: 10831 - DNA, 32 bp, Homo sapiens
ggcctcctgagtagctgggattacaggcatgc

SEQ ID NO: 10832 - DNA, 32 bp, Homo sapiens
ccaagttcaggcaattctcctgccccagcctc

SEQ ID NO: 10833 - DNA, 32 bp, Homo sapiens
aggcaaaggcctggacagcttgacttgtgggg

SEQ ID NO: 10834 - DNA, 32 bp, Homo sapiens
agcctcccaagtagctgggattacaggcatgt

SEQ ID NO: 10835 - DNA, 24 bp, Homo sapiens
gatggggaaactgaggccttgaga

SEQ ID NO: 10836 - DNA, 32 bp, Homo sapiens
gctctgtcacccaggtggctggagtacagtgg

SEQ ID NO: 10837 - DNA, 32 bp, Homo sapiens
ctgggctcaagcaatcctcctgcctcggcctc

SEQ ID NO: 10838 - DNA, 32 bp, Homo sapiens
ggaacatcccgagggtcacagggacagtgcag

SEQ ID NO: 10839 - DNA, 32 bp, Homo sapiens
ctagccccctctggaatccttctgcctactga

SEQ ID NO: 10840 - DNA, 32 bp, Homo sapiens
gctcctgtctgtttccccatcctgccagattt

SEQ ID NO: 10841 - DNA, 32 bp, Homo sapiens
tatccgagaagaggagggtagaaatgaaggaa

SEQ ID NO: 10842 - DNA, 32 bp, Homo sapiens
tttgtttatcagcctgagcatatttcatttta

SEQ ID NO: 10843 - DNA, 22 bp, Homo sapiens
tggacgatctcagctcactgca

SEQ ID NO: 10844 - DNA, 32 bp, Homo sapiens
ctgggtaacaggcagaggttggaacagtttgg

SEQ ID NO: 10845 - DNA, 32 bp, Homo sapiens
agtaacttcatgaatactacaaacttccagtc

SEQ ID NO: 10846 - DNA, 32 bp, Homo sapiens
ccccagccctcggctgcctcttaactttgggt

SEQ ID NO: 10847 - DNA, 32 bp, Homo sapiens
cactgtcacccaggccggagtgcagtggcaca

SEQ ID NO: 10848 - DNA, 32 bp, Homo sapiens
atgtgtccaatgctgccttcccatgaatctgt

SEQ ID NO: 10849 - DNA, 22 bp, Homo sapiens
tcacacctaatcccagcacttt

SEQ ID NO: 10850 - DNA, 32 bp, Homo sapiens
ctcattaatttccaggtggaggaaatggagga

SEQ ID NO: 10851 - DNA, 32 bp, Homo sapiens
tggttcatgcctgtaatccagcactttgggag

SEQ ID NO: 10852 - DNA, 32 bp, Homo sapiens
tgcctacatcttctctcttccccatcttgcat

SEQ ID NO: 10853 - DNA, 20 bp, Homo sapiens
gtgccacacccaggcagctg

SEQ ID NO: 10854 - DNA, 20 bp, Homo sapiens
gcccccgccctgtcccaagg

SEQ ID NO: 10855 - DNA, 24 bp, Homo sapiens
ctgtcacccaggctggagtgcaat

SEQ ID NO: 10856 - DNA, 32 bp, Homo sapiens
cctcctcatcttcttcctgctcctccacctcc

SEQ ID NO: 10857 - DNA, 32 bp, Homo sapiens
ctgccccagcttctcccaccatagggggccgg

SEQ ID NO: 10858 - DNA, 23 bp, Homo sapiens
tggcacactctccgctcactgca

SEQ ID NO: 10859 - DNA, 32 bp, Homo sapiens
cctgcagccctctgctcctcccggccgctgca

SEQ ID NO: 10860 - DNA, 24 bp, Homo sapiens
ctgtcgcccaggctggagtgcgat

SEQ ID NO: 10861 - DNA, 32 bp, Homo sapiens
ggtctgttgcccaggctggagtgcagtggtgt

SEQ ID NO: 10862 - DNA, 32 bp, Homo sapiens
tttggaccagttcttgtgccattggcaggatg

SEQ ID NO: 10863 - DNA, 32 bp, Homo sapiens
ttgaaatggagttttgctcttgttgcccaggc

SEQ ID NO: 10864 - DNA, 22 bp, Homo sapiens
gctccccttcctggccctcccc

SEQ ID NO: 10865 - DNA, 32 bp, Homo sapiens
atcaatgttattctccctcccaccacttccca

SEQ ID NO: 10866 - DNA, 32 bp, Homo sapiens
agccacctgagcagctgggattgcaggtgcat

SEQ ID NO: 10867 - DNA, 32 bp, Homo sapiens
ctactcgggaggctgagacaggagaatcactt

SEQ ID NO: 10868 - DNA, 24 bp, Homo sapiens
tcacacctgtaatccctgcatttt

SEQ ID NO: 10869 - DNA, 32 bp, Homo sapiens
aggacaaggagaggagacaagtgacgacagcc

SEQ ID NO: 10870 - DNA, 32 bp, Homo sapiens
gcagctcgtagaggagagaaaacaagagtgga

SEQ ID NO: 10871 - DNA, 32 bp, Homo sapiens
aggtgcccctgcctggagcacagggtcccacg

SEQ ID NO: 10872 - DNA, 32 bp, Homo sapiens
tgcttggcagaccttcatcttctgcctcaact

SEQ ID NO: 10873 - DNA, 22 bp, Homo sapiens
tgaccagcaaggtcagaggccc

SEQ ID NO: 10874 - DNA, 32 bp, Homo sapiens
ctcccttcctccctttcttaccacagatggga

SEQ ID NO: 10875 - DNA, 32 bp, Homo sapiens
ggattatattaattgctaaatattttattcac

SEQ ID NO: 10876 - DNA, 24 bp, Homo sapiens
tgacacgacctcggctcactgcag

SEQ ID NO: 10877 - DNA, 32 bp, Homo sapiens
gctctgtcccccatgctggagtgcagtggcat

SEQ ID NO: 10878 - DNA, 32 bp, Homo sapiens
tccctgttgcccaagttggagtgcaatcttgg

SEQ ID NO: 10879 - DNA, 32 bp, Homo sapiens
cctctgtcgtccaggctggagtgcagtggcac

SEQ ID NO: 10880 - DNA, 32 bp, Homo sapiens
gagagctgaagtgccccagccagcagctagcc

SEQ ID NO: 10881 - DNA, 32 bp, Homo sapiens
tccgtggagaggcagagctttcatactgaatt

SEQ ID NO: 10882 - DNA, 32 bp, Homo sapiens
cactctgttgccaggctggaatgcagtggcgt

SEQ ID NO: 10883 - DNA, 32 bp, Homo sapiens
gagcaggccccaggctggacctgccctgtcct

SEQ ID NO: 10884 - DNA, 32 bp, Homo sapiens
ctctgtcacctaggctggattgcaatggtgca

SEQ ID NO: 10885 - DNA, 32 bp, Homo sapiens
ttctgtaacccaggctggagtgcagtggcctg

SEQ ID NO: 10886 - DNA, 32 bp, Homo sapiens
gtcctcagcgtttatctcaggtgcggaaggtc

SEQ ID NO: 10887 - DNA, 32 bp, Homo sapiens
agagtcctgagtacctcgtgggaacttgggca

SEQ ID NO: 10888 - DNA, 32 bp, Homo sapiens
ctattttgcccaggctggagtgcgatggtgcg

SEQ ID NO: 10889 - DNA, 32 bp, Homo sapiens
gctctgtcgcctaagctggagtgtggtggcac

SEQ ID NO: 10890 - DNA, 32 bp, Homo sapiens
ttcttttaattccccatgatgttttcaattat

SEQ ID NO: 10891 - DNA, 32 bp, Homo sapiens
gtaaaatggtagttggctcttgtgctcaattt

SEQ ID NO: 10892 - DNA, 32 bp, Homo sapiens
gcctccacctccagggttcaagcgattctcct

SEQ ID NO: 10893 - DNA, 32 bp, Homo sapiens
agcctcccgagtagctgggattataggcacct

SEQ ID NO: 10894 - DNA, 32 bp, Homo sapiens
agcctcctgagtagctgggattacaggcacct

SEQ ID NO: 10895 - DNA, 32 bp, Homo sapiens
agcctcctgagtagctgggactacaggcgtgt

SEQ ID NO: 10896 - DNA, 32 bp, Homo sapiens
gaacccaggaggcagaggttggggtgagctga

SEQ ID NO: 10897 - DNA, 32 bp, Homo sapiens
agcctcccgagtagctgggattacaggcaccc

SEQ ID NO: 10898 - DNA, 32 bp, Homo sapiens
agcctcccaaagtgctgggattactggtgtga

SEQ ID NO: 10899 - DNA, 32 bp, Homo sapiens
attggtcctagagaaaagactatgtcatttac

SEQ ID NO: 10900 - DNA, 32 bp, Homo sapiens
gagtctgggaggcaggtttccaagagcaggga

SEQ ID NO: 10901 - DNA, 32 bp, Homo sapiens
gaaccggggaggcagaggttgcagtgagctga

SEQ ID NO: 10902 - DNA, 32 bp, Homo sapiens
caaggaactggaggagaagacagccacgctca

SEQ ID NO: 10903 - DNA, 32 bp, Homo sapiens
agcgacacaagtgccctgggcgcgtgcagccc

SEQ ID NO: 10904 - DNA, 32 bp, Homo sapiens
gcccacagagatgagaatagatcatgtggaac

SEQ ID NO: 10905 - DNA, 23 bp, Homo sapiens
tgaccacgtgctacccccatgct

SEQ ID NO: 10906 - DNA, 32 bp, Homo sapiens
ccgtcccgtcccgtccccatcggaaccccaag

SEQ ID NO: 10907 - DNA, 23 bp, Homo sapiens
cacacctataatctcagcacttt

SEQ ID NO: 10908 - DNA, 32 bp, Homo sapiens
cctcagtcgctcaggctggagtgcagtggcgc

SEQ ID NO: 10909 - DNA, 32 bp, Homo sapiens
ggatttgtctgagacatttccaagcagactgt

SEQ ID NO: 10910 - DNA, 32 bp, Homo sapiens
tccacagcctgagaggtgtccccaaagaaagg

SEQ ID NO: 10911 - DNA, 32 bp, Homo sapiens
gggatgaagaattgactgggagctgaggaggg

SEQ ID NO: 10912 - DNA, 32 bp, Homo sapiens
aatcgaaggaattggcccaatggcgaggagag

SEQ ID NO: 10913 - DNA, 32 bp, Homo sapiens
cgccatcgtcccggctgaagtgcagtggcacg

SEQ ID NO: 10914 - DNA, 32 bp, Homo sapiens
gggttcccagactgaattgtcagtgagcggag

SEQ ID NO: 10915 - DNA, 32 bp, Homo sapiens
attctcctgagtagctgggattgctggtgcac

SEQ ID NO: 10916 - DNA, 32 bp, Homo sapiens
ctacttgggaggcagaggcaggagaatcgctt

SEQ ID NO: 10917 - DNA, 32 bp, Homo sapiens
gaacccgggaggcagaggttgaagtgagctga

SEQ ID NO: 10918 - DNA, 32 bp, Homo sapiens
gaacctgggaggcggaggttgcagtgagcgga

SEQ ID NO: 10919 - DNA, 32 bp, Homo sapiens
aggaacagaagaggaaagagagacacagctgc

SEQ ID NO: 10920 - DNA, 32 bp, Homo sapiens
tcaaagaggaaaggagaaaaacaaacagacca

SEQ ID NO: 10921 - DNA, 32 bp, Homo sapiens
gctccagcctgggtgaggagaccctgtcctaa

SEQ ID NO: 10922 - DNA, 23 bp, Homo sapiens
ctgcaggaattgggggctgggaa

SEQ ID NO: 10923 - DNA, 32 bp, Homo sapiens
ggacaacgcaacctacctcacagggttgttgt

SEQ ID NO: 10924 - DNA, 32 bp, Homo sapiens
ctggatcttgaccttgaactggactctgtagg

SEQ ID NO: 10925 - DNA, 32 bp, Homo sapiens
acacagctccccagactggaggctggtcagag

SEQ ID NO: 10926 - DNA, 32 bp, Homo sapiens
taatatggatttctgctccttgttgcttgcta

SEQ ID NO: 10927 - DNA, 32 bp, Homo sapiens
tacctgtttctgctgctagaagatccaggaaa

SEQ ID NO: 10928 - DNA, 32 bp, Homo sapiens
gtggaagaatttcgtgccatgtggaaactttt

SEQ ID NO: 10929 - DNA, 32 bp, Homo sapiens
acctccacctctcaggttcaagcaattctcct

SEQ ID NO: 10930 - DNA, 32 bp, Homo sapiens
ctaagtcactgaggctggagtacagtggcatg

SEQ ID NO: 10931 - DNA, 32 bp, Homo sapiens
gcttctaagccaaaaggattcctctttgttta

SEQ ID NO: 10932 - DNA, 32 bp, Homo sapiens
aatggttgaagggagagagaattctttaaaat

SEQ ID NO: 10933 - DNA, 32 bp, Homo sapiens
cagctggttctgctgcttggtttcaacacctt

SEQ ID NO: 10934 - DNA, 32 bp, Homo sapiens
cattttctgctgctgctgacagattaacccaa

SEQ ID NO: 10935 - DNA, 32 bp, Homo sapiens
gaagcagattttaaccccatctggcagccatt

SEQ ID NO: 10936 - DNA, 32 bp, Homo sapiens
tgggacctgagtagctgggaccacaggcatgc

SEQ ID NO: 10937 - DNA, 32 bp, Homo sapiens
aggaattaaggagacttcctgtaatatttctt

SEQ ID NO: 10938 - DNA, 32 bp, Homo sapiens
acctcctgctcctgggttcgagcgattctcct

SEQ ID NO: 10939 - DNA, 32 bp, Homo sapiens
ccccaccacatcctgccattgctcaccctttc

SEQ ID NO: 10940 - DNA, 32 bp, Homo sapiens
caatattggtgactacctaaatgtgatttttg

SEQ ID NO: 10941 - DNA, 32 bp, Homo sapiens
tacctactgagtaggcggcgatttttgtatgt

SEQ ID NO: 10942 - DNA, 32 bp, Homo sapiens
ataccaagaagagggagctgaaaaggaaaatt

SEQ ID NO: 10943 - DNA, 32 bp, Homo sapiens
aaacacggaagaggaagaggaaagcaaaggag

SEQ ID NO: 10944 - DNA, 32 bp, Homo sapiens
agcaagaaaagtgaagaaagaatgcagaattg

SEQ ID NO: 10945 - DNA, 32 bp, Homo sapiens
ttgagatggagtttcgcttttgttgcccaggc

SEQ ID NO: 10946 - DNA, 21 bp, Homo sapiens
ctggaaaagctggggtagttg

SEQ ID NO: 10947 - DNA, 32 bp, Homo sapiens
gcaggggtctgcttcaggaaatggaagctgtc

SEQ ID NO: 10948 - DNA, 32 bp, Homo sapiens
ttatccgcgatgcgtttcctggcagctacatt

SEQ ID NO: 10949 - DNA, 32 bp, Homo sapiens
gtgtctgcctccatatgcatctgggcatttca

SEQ ID NO: 10950 - DNA, 32 bp, Homo sapiens
aaatgtgcagaactgtagaaactttagaggca

SEQ ID NO: 10951 - DNA, 32 bp, Homo sapiens
ctaggctcaagccattttcccacctcagcctc

SEQ ID NO: 10952 - DNA, 32 bp, Homo sapiens
cctgtaagaaaatgaatgttgtggaaattctt

SEQ ID NO: 10953 - DNA, 32 bp, Homo sapiens
tggccaccagcctcgtcacatacaccagcatc

SEQ ID NO: 10954 - DNA, 32 bp, Homo sapiens
gcatgtcccctgcttgaacactgaagggcagg

SEQ ID NO: 10955 - DNA, 32 bp, Homo sapiens
catgtaaatttcccagaagttgttgagctcaa

SEQ ID NO: 10956 - DNA, 32 bp, Homo sapiens
gtgacttgcccagggcagaggtttttgaagtg

SEQ ID NO: 10957 - DNA, 32 bp, Homo sapiens
actctgtcgcccaggctggagtgcagtgtcaa

SEQ ID NO: 10958 - DNA, 32 bp, Homo sapiens
gttgtttgcctttcaaccttgttttacagttc

SEQ ID NO: 10959 - DNA, 32 bp, Homo sapiens
agccttcggagtggctgggattacaggtgtgc

SEQ ID NO: 10960 - DNA, 32 bp, Homo sapiens
taatgggaagccagaacataattctttttcga

SEQ ID NO: 10961 - DNA, 32 bp, Homo sapiens
ctgactgctctgcaaaccccagccgaggacct

SEQ ID NO: 10962 - DNA, 32 bp, Homo sapiens
agcctccccagtagctgggattacaggcacca

SEQ ID NO: 10963 - DNA, 32 bp, Homo sapiens
cgatgaagattgtatttttgcaccttaactcc

SEQ ID NO: 10964 - DNA, 32 bp, Homo sapiens
ctgggctcaagcaatcctcccacctcagcctc

SEQ ID NO: 10965 - DNA, 32 bp, Homo sapiens
tctgtggcaaagctcttagaattctttgcagt

SEQ ID NO: 10966 - DNA, 32 bp, Homo sapiens
tcttgttgcccaggctggtgtgcaatggcgtg

SEQ ID NO: 10967 - DNA, 32 bp, Homo sapiens
aatgaatgaatggcttggagtgcactgagaac

SEQ ID NO: 10968 - DNA, 32 bp, Homo sapiens
ctctgttgcccaggctggagtacattggtgtg

SEQ ID NO: 10969 - DNA, 32 bp, Homo sapiens
gtttctcatcttctctctactgcctctgagtt

SEQ ID NO: 10970 - DNA, 32 bp, Homo sapiens
attttggagaagggagaaagaagggagaggca

SEQ ID NO: 10971 - DNA, 32 bp, Homo sapiens
gacccagggaggtcgatgctgcagtgagctat

SEQ ID NO: 10972 - DNA, 22 bp, Homo sapiens
tggctcgatctcggctcactgc

SEQ ID NO: 10973 - DNA, 22 bp, Homo sapiens
ggcgtgatctcagctcactgca

SEQ ID NO: 10974 - DNA, 19 bp, Homo sapiens
accagccaggacagggcct

SEQ ID NO: 10975 - DNA, 32 bp, Homo sapiens
ctcttgtcgcccaggctggagtgcagtggcgc

SEQ ID NO: 10976 - DNA, 32 bp, Homo sapiens
aagcagagaattttatttatagctaattttag

SEQ ID NO: 10977 - DNA, 19 bp, Homo sapiens
cagggccctcttccaactc

SEQ ID NO: 10978 - DNA, 32 bp, Homo sapiens
ggtagattcaaagctccacccacctcatccca

SEQ ID NO: 10979 - DNA, 32 bp, Homo sapiens
atcatcccaacaaaatatgaaacttctgtaag

SEQ ID NO: 10980 - DNA, 20 bp, Homo sapiens
tctgcaaaacagccaatgct

SEQ ID NO: 10981 - DNA, 28 bp, Homo sapiens
cagatcttaaatgctgcctatcatgttg

SEQ ID NO: 10982 - DNA, 32 bp, Homo sapiens
gaacccgggaggcaaaggttgcggtaagctgc

SEQ ID NO: 10983 - DNA, 32 bp, Homo sapiens
acatctgtgttcttcctgtcagctccacgccc

SEQ ID NO: 10984 - DNA, 32 bp, Homo sapiens
ttctttctctataactaacacagggatcactg

SEQ ID NO: 10985 - DNA, 32 bp, Homo sapiens
cactctcagaggtacctcaagagaccaaagag

SEQ ID NO: 10986 - DNA, 32 bp, Homo sapiens
tcctcttttgccaggctggatgctgtcgtctc

SEQ ID NO: 10987 - DNA, 32 bp, Homo sapiens
ctcttgttgcccaggctggagtgtgatgggct

SEQ ID NO: 10988 - DNA, 32 bp, Homo sapiens
tcagtaccagttctgccagccacagtgagccc

SEQ ID NO: 10989 - DNA, 32 bp, Homo sapiens
agaaactgcggcaggccgggtgcagtgtctca

SEQ ID NO: 10990 - DNA, 32 bp, Homo sapiens
tccaggccaccttctccatctgctcactgagg

SEQ ID NO: 10991 - DNA, 32 bp, Homo sapiens
ggcgtcagaaaaatggctacaaacttcctagc

SEQ ID NO: 10992 - DNA, 32 bp, Homo sapiens
gctgtcagccattcctgttcccatgagatgat

SEQ ID NO: 10993 - DNA, 32 bp, Homo sapiens
ttgtacccagatagctgggattggaagtgagg

SEQ ID NO: 10994 - DNA, 32 bp, Homo sapiens
tgagggttgcagagcccgctgtggaggtaaga

SEQ ID NO: 10995 - DNA, 32 bp, Homo sapiens
tgggacactagaacaggaaggctcctgggcct

SEQ ID NO: 10996 - DNA, 32 bp, Homo sapiens
tccattcactctgtttctcttctgctggatta

SEQ ID NO: 10997 - DNA, 28 bp, Homo sapiens
attattacaagtgctgtattatttgact

SEQ ID NO: 10998 - DNA, 32 bp, Homo sapiens
gagccctagaggttgaggctgcagtgagctat

SEQ ID NO: 10999 - DNA, 32 bp, Homo sapiens
gtgattcctcaaggatctagaaccagaaatat

SEQ ID NO: 11000 - DNA, 32 bp, Homo sapiens
acccagcacccaaggttcagtgacacagggtg

SEQ ID NO: 11001 - DNA, 32 bp, Homo sapiens
ccctactctgcagcctttcccatgctctgccc

SEQ ID NO: 11002 - DNA, 24 bp, Homo sapiens
tggcatcattgtaactcactgcag

SEQ ID NO: 11003 - DNA, 23 bp, Homo sapiens
tggcaagatctcggctcactgca

SEQ ID NO: 11004 - DNA, 32 bp, Homo sapiens
actcccatgctgctgttggctccatctctcca

SEQ ID NO: 11005 - DNA, 32 bp, Homo sapiens
ttcttgtcacccagactggagtgcgatggcac

SEQ ID NO: 11006 - DNA, 32 bp, Homo sapiens
ttgagatggaattttgctcttgtcacccaggc

SEQ ID NO: 11007 - DNA, 23 bp, Homo sapiens
tggcgagatctcagctcactgca

SEQ ID NO: 11008 - DNA, 32 bp, Homo sapiens
ttggctaagaattgtgtcgttgtggggtgggc

SEQ ID NO: 11009 - DNA, 32 bp, Homo sapiens
ctctgtcacccaagatggagtgcaatggcacg

SEQ ID NO: 11010 - DNA, 32 bp, Homo sapiens
ctacaccgcccaggccagagtagggtggagct

SEQ ID NO: 11011 - DNA, 32 bp, Homo sapiens
ggtccagggcctgggaaatttctacttatcct

SEQ ID NO: 11012 - DNA, 32 bp, Homo sapiens
gagccctggagttcaaggctgcagtgagctgt

SEQ ID NO: 11013 - DNA, 32 bp, Homo sapiens
ccttatgtggagcagaggttgtctctgaacca

SEQ ID NO: 11014 - DNA, 32 bp, Homo sapiens
gcagtgtgcccaggattgaaggtgtaaatggg

SEQ ID NO: 11015 - DNA, 32 bp, Homo sapiens
cacgccatctccatccccatcttgagtcctgg

SEQ ID NO: 11016 - DNA, 32 bp, Homo sapiens
gtcggaggaagaggagggaggagggaggccga

SEQ ID NO: 11017 - DNA, 32 bp, Homo sapiens
ggccaccatggtgtgaggagaccatcacctcg

SEQ ID NO: 11018 - DNA, 19 bp, Homo sapiens
aagctttctgtgacagttc

SEQ ID NO: 11019 - DNA, 24 bp, Homo sapiens
tggcataatctcagctcactgcag

SEQ ID NO: 11020 - DNA, 19 bp, Homo sapiens
tgtggggtgggagtgggga

SEQ ID NO: 11021 - DNA, 32 bp, Homo sapiens
aaagagtgagtcttctgattggcagctgtggc

SEQ ID NO: 11022 - DNA, 32 bp, Homo sapiens
gctctgttgcccaggctggagtgcagcggcat

SEQ ID NO: 11023 - DNA, 32 bp, Homo sapiens
gaggtgggaagaggatgaggagcaaagttggg

SEQ ID NO: 11024 - DNA, 32 bp, Homo sapiens
gccgagggcccaggccctgtgtgcggtgccca

SEQ ID NO: 11025 - DNA, 32 bp, Homo sapiens
ctctgtcacccaggctggagtgcagtggcgcc

SEQ ID NO: 11026 - DNA, 32 bp, Homo sapiens
agttcctctagtgccctccacagccgcagcct

SEQ ID NO: 11027 - DNA, 32 bp, Homo sapiens
agttggttgggtagtaggttgcattatgagta

SEQ ID NO: 11028 - DNA, 32 bp, Homo sapiens
aggacctgcccaggtatgccttccagtgatgc

SEQ ID NO: 11029 - DNA, 32 bp, Homo sapiens
ctccttcccctggacatctcctagagaggaat

SEQ ID NO: 11030 - DNA, 32 bp, Homo sapiens
cctgaccatcttctcctcccagggccacagct

SEQ ID NO: 11031 - DNA, 32 bp, Homo sapiens
aattttagaagaggtagagaaaatggaacatt

SEQ ID NO: 11032 - DNA, 32 bp, Homo sapiens
tttccagagggggagcccagagcttgaaaggc

SEQ ID NO: 11033 - DNA, 23 bp, Homo sapiens
tggcacgatcttggcttactgca

SEQ ID NO: 11034 - DNA, 32 bp, Homo sapiens
tggaatcatccctgtcatgtaaataggaaatc

SEQ ID NO: 11035 - DNA, 32 bp, Homo sapiens
ttttgttgcccaggctggagtgcaatggtgca

SEQ ID NO: 11036 - DNA, 32 bp, Homo sapiens
tcttgttgcccaggctggagtgcaacggtgca

SEQ ID NO: 11037 - DNA, 32 bp, Homo sapiens
taaaagttggaaaggctggagccgtgtgtgtg

SEQ ID NO: 11038 - DNA, 32 bp, Homo sapiens
acatgtaagaattgcttgttgggaagagtgct

SEQ ID NO: 11039 - DNA, 32 bp, Homo sapiens
atttacccaagtgttcagcttattcaccccac

SEQ ID NO: 11040 - DNA, 32 bp, Homo sapiens
agctccgggaggctgcagtggcggcagctgag

SEQ ID NO: 11041 - DNA, 32 bp, Homo sapiens
tatgcctgtaccgatggcatggtgctatatcc

SEQ ID NO: 11042 - DNA, 32 bp, Homo sapiens
atacccaacagaacatgactgtttctttgagg

SEQ ID NO: 11043 - DNA, 32 bp, Homo sapiens
atcttaatacaacatggacaccacgttgctga

SEQ ID NO: 11044 - DNA, 18 bp, Homo sapiens
gtctaatcccagcacttt

SEQ ID NO: 11045 - DNA, 32 bp, Homo sapiens
actctttcacccagactggagggcagcggcga

SEQ ID NO: 11046 - DNA, 32 bp, Homo sapiens
gtgagcgccctctctctccggcggagcggaga

SEQ ID NO: 11047 - DNA, 32 bp, Homo sapiens
ttgtgtcctccaggagcttcttgtttccttgt

SEQ ID NO: 11048 - DNA, 19 bp, Homo sapiens
gcccctgctcctgcccagg

SEQ ID NO: 11049 - DNA, 24 bp, Homo sapiens
acctttatcgccaatgcacagctt

SEQ ID NO: 11050 - DNA, 32 bp, Homo sapiens
gaacctgagaggtggaggttgcagtgagccga

SEQ ID NO: 11051 - DNA, 32 bp, Homo sapiens
aaggggaggttagggaggtttgaagagtgaga

SEQ ID NO: 11052 - DNA, 32 bp, Homo sapiens
agactttgcccagggtcctgtgcctggatggg

SEQ ID NO: 11053 - DNA, 32 bp, Homo sapiens
tatctctctgcaggctcgcctctgggctttgt

SEQ ID NO: 11054 - DNA, 32 bp, Homo sapiens
tcgcatagtcacgtagctcccaccccaccctc

SEQ ID NO: 11055 - DNA, 32 bp, Homo sapiens
tggcagcataaatattatgataagctaaaagc

SEQ ID NO: 11056 - DNA, 32 bp, Homo sapiens
gagtgttgggactgactcctggaagacagcct

SEQ ID NO: 11057 - DNA, 32 bp, Homo sapiens
cactgtcacccaggctggagtgcagtggcgcg

SEQ ID NO: 11058 - DNA, 32 bp, Homo sapiens
ctgtgtcacctaggctggagtgcagtggcaca

SEQ ID NO: 11059 - DNA, 32 bp, Homo sapiens
cactgtcgcccaggctggagtgcagtggcgca

SEQ ID NO: 11060 - DNA, 32 bp, Homo sapiens
cagtgtctaagtgcttctcttgtgtcctgtag

SEQ ID NO: 11061 - DNA, 17 bp, Homo sapiens
aggctgacttgcctgaa

SEQ ID NO: 11062 - DNA, 32 bp, Homo sapiens
tgtttgccaagtgcctggcccagagcaagtgg

SEQ ID NO: 11063 - DNA, 32 bp, Homo sapiens
cgactgtgctcgctgctcagcgccgcacccgg

SEQ ID NO: 11064 - DNA, 32 bp, Homo sapiens
atctctcttgcttttccccacagggtcaaggt

SEQ ID NO: 11065 - DNA, 32 bp, Homo sapiens
tcattctctgcagcagctgcctgggcccaagg

SEQ ID NO: 11066 - DNA, 32 bp, Homo sapiens
ctaggtggagcggatggaatgtgctgggccac

SEQ ID NO: 11067 - DNA, 32 bp, Homo sapiens
tctttgttgcccaggctggagtgcaatggcgc

SEQ ID NO: 11068 - DNA, 32 bp, Homo sapiens
ctaaatcctcatctgtcatatcaagaaatcac

SEQ ID NO: 11069 - DNA, 32 bp, Homo sapiens
cactgctcctgcctctagggtgcagtgtccgt

SEQ ID NO: 11070 - DNA, 28 bp, Homo sapiens
gggctcagggctgctgccttcctgtcct

SEQ ID NO: 11071 - DNA, 32 bp, Homo sapiens
gagcccaggagtttgaggatgcagtgagctat

SEQ ID NO: 11072 - DNA, 32 bp, Homo sapiens
gtcccagctccaggctggagccagtgaagggt

SEQ ID NO: 11073 - DNA, 28 bp, Homo sapiens
ctctaattaagaactgcctcattgagcc

SEQ ID NO: 11074 - DNA, 28 bp, Homo sapiens
cctagttcagtgtctgcctcatgggaag

SEQ ID NO: 11075 - DNA, 28 bp, Homo sapiens
ctagcccagcgctctgcctcaccgcttc

SEQ ID NO: 11076 - DNA, 25 bp, Homo sapiens
ccagaaatacagcagccactttgca

SEQ ID NO: 11077 - DNA, 32 bp, Homo sapiens
ttagtctctgcagtctcttgtcttgaattaat

SEQ ID NO: 11078 - DNA, 32 bp, Homo sapiens
tcgccccatcttctccgtggatgggccatgcg

SEQ ID NO: 11079 - DNA, 32 bp, Homo sapiens
acatggtggccacagctggagtgaccgcagtg

SEQ ID NO: 11080 - DNA, 32 bp, Homo sapiens
ctgagatggagtttcactcttgttgcccaggc

SEQ ID NO: 11081 - DNA, 21 bp, Homo sapiens
tggcacaatcagctcactgca

SEQ ID NO: 11082 - DNA, 32 bp, Homo sapiens
ctgggttcaagtaattctcctgcctcagcttt

SEQ ID NO: 11083 - DNA, 32 bp, Homo sapiens
gatctcagactatcctgattaatctggggaag

SEQ ID NO: 11084 - DNA, 16 bp, Homo sapiens
aggggctgttgctgaa

SEQ ID NO: 11085 - DNA, 32 bp, Homo sapiens
gctctgtcacccaggctgtagtggagtggtgt

SEQ ID NO: 11086 - DNA, 32 bp, Homo sapiens
actgatcagttctctgaaaatatttccaaaat

SEQ ID NO: 11087 - DNA, 32 bp, Homo sapiens
ttggggatggagtctcactttgttgcccaggc

SEQ ID NO: 11088 - DNA, 24 bp, Homo sapiens
acaggcatcagccaccacacctgg

SEQ ID NO: 11089 - DNA, 32 bp, Homo sapiens
gttgtgccaagtgcaataaaccagtcacaaaa

SEQ ID NO: 11090 - DNA, 32 bp, Homo sapiens
cggagcctcccaggctggggcagtgggcatgg

SEQ ID NO: 11091 - DNA, 32 bp, Homo sapiens
gtcgtgaactcctggcttcaagcagtcctcct

SEQ ID NO: 11092 - DNA, 32 bp, Homo sapiens
cactgcaaagagacgcttcaagtggggagaag

SEQ ID NO: 11093 - DNA, 32 bp, Homo sapiens
tcactgtcgcccaggctggagtgcggtggtgc

SEQ ID NO: 11094 - DNA, 32 bp, Homo sapiens
tctttgaagccagcatcctagcatcttcaaat

SEQ ID NO: 11095 - DNA, 32 bp, Homo sapiens
agcctcctgagtagctgggactacaggctcat

SEQ ID NO: 11096 - DNA, 32 bp, Homo sapiens
agcctctgaagtagctgggattacaggcatgt

SEQ ID NO: 11097 - DNA, 32 bp, Homo sapiens
gagcctgggaggcggaggttgcagtgagccga

SEQ ID NO: 11098 - DNA, 32 bp, Homo sapiens
gaatccgggaggcgggtcttgcagtgagcaga

SEQ ID NO: 11099 - DNA, 32 bp, Homo sapiens
ctggcctcaagcaatcctcccacctgagcccc

SEQ ID NO: 11100 - DNA, 32 bp, Homo sapiens
ttcagcgggaggcagcagaggggaagtggtca

SEQ ID NO: 11101 - DNA, 32 bp, Homo sapiens
gagcccgggaggcggaggttgcagtgagctga

SEQ ID NO: 11102 - DNA, 32 bp, Homo sapiens
gaacttgggaggtggaggttgcagtgggccga

SEQ ID NO: 11103 - DNA, 32 bp, Homo sapiens
tggccggctcctctccccatctgccttctcct

SEQ ID NO: 11104 - DNA, 23 bp, Homo sapiens
tcatgctgtaatcccatcacttt

SEQ ID NO: 11105 - DNA, 21 bp, Homo sapiens
tatattaagcagcccagcctt

SEQ ID NO: 11106 - DNA, 32 bp, Homo sapiens
ccctttccctctaacccacaccacctttctac

SEQ ID NO: 11107 - DNA, 32 bp, Homo sapiens
tctcactctgcagggatcctcctgcctctcct

SEQ ID NO: 11108 - DNA, 32 bp, Homo sapiens
acataggctatatcctggaagtgggcagggga

SEQ ID NO: 11109 - DNA, 32 bp, Homo sapiens
ccgactgtgctgctcgcgaaggtcccacagcc

SEQ ID NO: 11110 - DNA, 32 bp, Homo sapiens
tcgatagttacccaaagttcagtctagatggc

SEQ ID NO: 11111 - DNA, 23 bp, Homo sapiens
ccagaccgcggccttcagtgtca

SEQ ID NO: 11112 - DNA, 32 bp, Homo sapiens
gccctgttgcccaggctggagtgcagtggcac

SEQ ID NO: 11113 - DNA, 32 bp, Homo sapiens
attgatccagttgtcatccaccacagacatct

SEQ ID NO: 11114 - DNA, 32 bp, Homo sapiens
ccatacaggcaacttagctggtgaaaggactc

SEQ ID NO: 11115 - DNA, 32 bp, Homo sapiens
cgctgcgggcagggttctcccagcacctcact

SEQ ID NO: 11116 - DNA, 32 bp, Homo sapiens
ttacacccttgttctgtcaaagcaattaaaga

SEQ ID NO: 11117 - DNA, 28 bp, Homo sapiens
tcctcattcccagctgcctcttcctact

SEQ ID NO: 11118 - DNA, 32 bp, Homo sapiens
gttagggctggtggtgagggatcatgtaaaga

SEQ ID NO: 11119 - DNA, 32 bp, Homo sapiens
tccctcagccaggcagggttgcagctgagggc

SEQ ID NO: 11120 - DNA, 32 bp, Homo sapiens
tgtagatggagtttcacttttgttgcccaggc

SEQ ID NO: 11121 - DNA, 32 bp, Homo sapiens
gggcagcccttctcttctgctgtttaattcca

SEQ ID NO: 11122 - DNA, 19 bp, Homo sapiens
gccataagtggtccaggga

SEQ ID NO: 11123 - DNA, 32 bp, Homo sapiens
cactctgtcaccagactggagtgcagtggcgc

SEQ ID NO: 11124 - DNA, 32 bp, Homo sapiens
tgcttgttgcccaggctggagtgcagtggtgc

SEQ ID NO: 11125 - DNA, 32 bp, Homo sapiens
cattaccaatttctgtcaactaccatgagatg

SEQ ID NO: 11126 - DNA, 32 bp, Homo sapiens
gcacttttgaacttgacatcaaactttctgat

SEQ ID NO: 11127 - DNA, 32 bp, Homo sapiens
tcactgtcgcccaggctggagtgcagtggcgt

SEQ ID NO: 11128 - DNA, 32 bp, Homo sapiens
ggaaagttgcccaaggaagggaagttgagttc

SEQ ID NO: 11129 - DNA, 32 bp, Homo sapiens
tcttcccgaggccctggagtgccgtgcgtgtg

SEQ ID NO: 11130 - DNA, 32 bp, Homo sapiens
ctgggcccacagacaggaaatgacctgacctc

SEQ ID NO: 11131 - DNA, 32 bp, Homo sapiens
ggactcaaggatggcttcctggaggaaataca

SEQ ID NO: 11132 - DNA, 32 bp, Homo sapiens
ggaacccgggagcagagactgcagtgagctga

SEQ ID NO: 11133 - DNA, 32 bp, Homo sapiens
ctcttcgggaggcagccctggttctaggatgc

SEQ ID NO: 11134 - DNA, 32 bp, Homo sapiens
ctctgtcatccaggctggagtgcagtggtgtg

SEQ ID NO: 11135 - DNA, 32 bp, Homo sapiens
ttccaagaaagaggaggagagttgaaaagaga

SEQ ID NO: 11136 - DNA, 32 bp, Homo sapiens
gaaggtagaggaggagaaagaatccaaagatt

SEQ ID NO: 11137 - DNA, 32 bp, Homo sapiens
agcccaggagttaagaggctgcagtgaccgat

SEQ ID NO: 11138 - DNA, 19 bp, Homo sapiens
tgtggggaaagtatgtaga

SEQ ID NO: 11139 - DNA, 32 bp, Homo sapiens
gcctcccaacttctccccaggccaagtatggg

SEQ ID NO: 11140 - DNA, 20 bp, Homo sapiens
gcctgtaatcccaacacttt

SEQ ID NO: 11141 - DNA, 32 bp, Homo sapiens
ttctgtcacccaggctggagtgcagtggtgtg

SEQ ID NO: 11142 - DNA, 32 bp, Homo sapiens
cacagcctggactattcccaggcacagctgtg

SEQ ID NO: 11143 - DNA, 32 bp, Homo sapiens
ggctttaaaaatgcatgaaaccacctttaatt

SEQ ID NO: 11144 - DNA, 32 bp, Homo sapiens
cctcttctgggcctctgctcccctgggacctc

SEQ ID NO: 11145 - DNA, 32 bp, Homo sapiens
aaaccaaccttgagctgggaggtacgtgctct

SEQ ID NO: 11146 - DNA, 32 bp, Homo sapiens
tggtggggaaggggccatctgtggaagaaaca

SEQ ID NO: 11147 - DNA, 32 bp, Homo sapiens
ctggtgctgagcctctgctcccaccgggtgaa

SEQ ID NO: 11148 - DNA, 32 bp, Homo sapiens
gaacctgggaggtggaggttgcattgagctga

SEQ ID NO: 11149 - DNA, 32 bp, Homo sapiens
aactgcctcagtaaattcttagggatggaagt

SEQ ID NO: 11150 - DNA, 32 bp, Homo sapiens
aatgttgatggctattttgtggtgctaacatg

SEQ ID NO: 11151 - DNA, 32 bp, Homo sapiens
agccctgcctcctgggttcaagcaattctgta

SEQ ID NO: 11152 - DNA, 32 bp, Homo sapiens
ggcgcccgagtgagccttaacatccaggggct

SEQ ID NO: 11153 - DNA, 32 bp, Homo sapiens
gtgcccaggggttgcaggctgcagtgagctgt

SEQ ID NO: 11154 - DNA, 18 bp, Homo sapiens
ggcaaatgcaggactccc

SEQ ID NO: 11155 - DNA, 32 bp, Homo sapiens
gatatacatcttcttccttttggtttcttgat

SEQ ID NO: 11156 - DNA, 32 bp, Homo sapiens
ctccttcatttccaatatggcagggccatgag

SEQ ID NO: 11157 - DNA, 21 bp, Homo sapiens
ctgaccaacatggtgaaaccc

SEQ ID NO: 11158 - DNA, 32 bp, Homo sapiens
ttgagatggagtttcattcttgttgccgaggc

SEQ ID NO: 11159 - DNA, 32 bp, Homo sapiens
cgcgctgtgctgcctgtcttcgcgccactgtt

SEQ ID NO: 11160 - DNA, 32 bp, Homo sapiens
ctgacgccctccatttctctggctccggcccc

SEQ ID NO: 11161 - DNA, 32 bp, Homo sapiens
attctgtcacccagactggagtgcagtgccac

SEQ ID NO: 11162 - DNA, 21 bp, Homo sapiens
ctggccaacatagtgaaaccc

SEQ ID NO: 11163 - DNA, 32 bp, Homo sapiens
agcctcccaagtagctgggattacaggcgcct

SEQ ID NO: 11164 - DNA, 32 bp, Homo sapiens
ctccagatgaggtgctccgtggaacacgagga

SEQ ID NO: 11165 - DNA, 32 bp, Homo sapiens
ctcttttcaaacccaactgtgctgctaaccca

SEQ ID NO: 11166 - DNA, 32 bp, Homo sapiens
accttcgttgcaacttctcccatccgagtcac

SEQ ID NO: 11167 - DNA, 24 bp, Homo sapiens
ctgtcactcaggctagagtgcagt

SEQ ID NO: 11168 - DNA, 32 bp, Homo sapiens
cgactcactgcagctatctctcgcctcagccc

SEQ ID NO: 11169 - DNA, 32 bp, Homo sapiens
agggaggcctccatctggaaatgggaggatga

SEQ ID NO: 11170 - DNA, 32 bp, Homo sapiens
atgctcccaagtgccagggagggccgagcgag

SEQ ID NO: 11171 - DNA, 32 bp, Homo sapiens
agggctcatcccttattaagcatcagaaaatt

SEQ ID NO: 11172 - DNA, 32 bp, Homo sapiens
gctttggcccagccagcttcagatctggtctt

SEQ ID NO: 11173 - DNA, 24 bp, Homo sapiens
ctgtcactcaggctggagtgcaat

SEQ ID NO: 11174 - DNA, 32 bp, Homo sapiens
ttggggtgggaggatggatgcaactgaagcag

SEQ ID NO: 11175 - DNA, 32 bp, Homo sapiens
cctggaagagcaactctatctgatctcaaaat

SEQ ID NO: 11176 - DNA, 32 bp, Homo sapiens
aggcgagcagaactccccctggggaggaagct

SEQ ID NO: 11177 - DNA, 32 bp, Homo sapiens
cctagtctaggaggcacagaattctcattctg

SEQ ID NO: 11178 - DNA, 32 bp, Homo sapiens
agcgctcctggtagctgggactacaggcacag

SEQ ID NO: 11179 - DNA, 32 bp, Homo sapiens
acctccgccttctgggttcaagcagttctcgt

SEQ ID NO: 11180 - DNA, 32 bp, Homo sapiens
ccgggttcaagcgattctcccgcctcagcctc

SEQ ID NO: 11181 - DNA, 32 bp, Homo sapiens
gtctcctcatccgtccttcccacctcacaccc

SEQ ID NO: 11182 - DNA, 32 bp, Homo sapiens
ccggattcaagcaattctcccgcctcagcctc

SEQ ID NO: 11183 - DNA, 32 bp, Homo sapiens
actgcaaaggaaagagagagaaaacaagcaaa

SEQ ID NO: 11184 - DNA, 32 bp, Homo sapiens
gagcccaggaggtcagggctgcagtgagccga

SEQ ID NO: 11185 - DNA, 32 bp, Homo sapiens
ctctgtcacccaggctgcagtgcaatggcgcg

SEQ ID NO: 11186 - DNA, 32 bp, Homo sapiens
agccaccagctatttcctggtgacacaagctc

SEQ ID NO: 11187 - DNA, 32 bp, Homo sapiens
tatttgtttttgcacctgcttctgcctggaga

SEQ ID NO: 11188 - DNA, 32 bp, Homo sapiens
gtgaggctgggagcttctcttgggcctgctgg

SEQ ID NO: 11189 - DNA, 32 bp, Homo sapiens
ctctcatcacccaggctagagtgcagtggcac

SEQ ID NO: 11190 - DNA, 32 bp, Homo sapiens
tggctctggcccaggctagagtgcagtggtgc

SEQ ID NO: 11191 - DNA, 32 bp, Homo sapiens
gacgggcaccagtgggcataggcacaggatga

SEQ ID NO: 11192 - DNA, 32 bp, Homo sapiens
ctaggaggcccaggctggagtgaggtggcacg

SEQ ID NO: 11193 - DNA, 32 bp, Homo sapiens
gctgtgaaagagatctgtgaccttgcaccctg

SEQ ID NO: 11194 - DNA, 32 bp, Homo sapiens
ctcttgttgcccaggcttgagtgcagtgatgc

SEQ ID NO: 11195 - DNA, 32 bp, Homo sapiens
tggggtgagggacagagccccacgctgttgac

SEQ ID NO: 11196 - DNA, 32 bp, Homo sapiens
catcaatctttaaaccaattgctgctacttat

SEQ ID NO: 11197 - DNA, 32 bp, Homo sapiens
ctggcctcaggtgatctgcccacctcatcctc

SEQ ID NO: 11198 - DNA, 32 bp, Homo sapiens
ggctcatgcctgtaaccccagcactttgggag

SEQ ID NO: 11199 - DNA, 17 bp, Homo sapiens
gcgcacacccaggcagc

SEQ ID NO: 11200 - DNA, 31 bp, Homo sapiens
ggggcggagagcgcgagaaggagggaggagg

SEQ ID NO: 11201 - DNA, 24 bp, Homo sapiens
tcacgcctgtaatcccagcaagtt

SEQ ID NO: 11202 - DNA, 16 bp, Homo sapiens
ggacttgttccagccc

SEQ ID NO: 11203 - DNA, 32 bp, Homo sapiens
ctgtagctgctgctgctccctgcccagcccca

SEQ ID NO: 11204 - DNA, 16 bp, Homo sapiens
ccatcatcacccagaa

SEQ ID NO: 11205 - DNA, 32 bp, Homo sapiens
ctcttgttgcccaggctggaatgcagtggcac

SEQ ID NO: 11206 - DNA, 32 bp, Homo sapiens
aggtattctttcctgacattgttttcagaata

SEQ ID NO: 11207 - DNA, 20 bp, Homo sapiens
gggccacagcacctgggcac

SEQ ID NO: 11208 - DNA, 32 bp, Homo sapiens
actcttgtgtccaggctggagtgcagtggcac

SEQ ID NO: 11209 - DNA, 32 bp, Homo sapiens
ctcttgttgcccaggctggagtacaatggtgc

SEQ ID NO: 11210 - DNA, 32 bp, Homo sapiens
ctcttgttgcccaggctggagtgcagtgacac

SEQ ID NO: 11211 - DNA, 28 bp, Homo sapiens
agcctacagagtagctgggaatacaagt

SEQ ID NO: 11212 - DNA, 32 bp, Homo sapiens
ccaagtcaacatcaggctactgaagttgaggc

SEQ ID NO: 11213 - DNA, 32 bp, Homo sapiens
atggtgctctggggctggaggctagtaaggaa

SEQ ID NO: 11214 - DNA, 32 bp, Homo sapiens
ctgggctcaagcaatctgcccgcctctgcctc

SEQ ID NO: 11215 - DNA, 32 bp, Homo sapiens
ggctcctgcctataatcccagcactttgggag

SEQ ID NO: 11216 - DNA, 32 bp, Homo sapiens
tcattagaccgagacatcactagaaattctgg

SEQ ID NO: 11217 - DNA, 21 bp, Homo sapiens
cgcctcgcccgagccccggga

SEQ ID NO: 11218 - DNA, 32 bp, Homo sapiens
ttattgcttcttctcccatctgcccgttgaca

SEQ ID NO: 11219 - DNA, 32 bp, Homo sapiens
tgtaagtgtgtagtttgatgagcttggacaaa

SEQ ID NO: 11220 - DNA, 32 bp, Homo sapiens
ttgagactgagtttcgctcttgtcatcctggc

SEQ ID NO: 11221 - DNA, 32 bp, Homo sapiens
cagaaacatccctcagccccacaggcacgatc

SEQ ID NO: 11222 - DNA, 32 bp, Homo sapiens
agcctccagagtagctgggattacaggcatgc

SEQ ID NO: 11223 - DNA, 32 bp, Homo sapiens
ttccaagagacacttttcctggaaagcccctg

SEQ ID NO: 11224 - DNA, 32 bp, Homo sapiens
agcctcccgagtagctgggattacaggcatga

SEQ ID NO: 11225 - DNA, 32 bp, Homo sapiens
agcttcccgagtagctgggattacaggtatga

SEQ ID NO: 11226 - DNA, 32 bp, Homo sapiens
tgcctcctgagtagctgggattactggcacac

SEQ ID NO: 11227 - DNA, 24 bp, Homo sapiens
tcacacctataatcccagcgcttt

SEQ ID NO: 11228 - DNA, 32 bp, Homo sapiens
agcctcctgagtagctgggattataggcacat

SEQ ID NO: 11229 - DNA, 32 bp, Homo sapiens
agcctcctgagtagctgggattacaggcacac

SEQ ID NO: 11230 - DNA, 32 bp, Homo sapiens
cctgacttaagagttttcaagatgtcaaactt

SEQ ID NO: 11231 - DNA, 32 bp, Homo sapiens
cagatgacctgagaccggtgttccggaaactg

SEQ ID NO: 11232 - DNA, 32 bp, Homo sapiens
ggcatctcacgtacccccatctgagacctctt

SEQ ID NO: 11233 - DNA, 32 bp, Homo sapiens
gtaagcccagttcttctctgtatagaaaggaa

SEQ ID NO: 11234 - DNA, 24 bp, Homo sapiens
tggcacgatcatggctcactgcag

SEQ ID NO: 11235 - DNA, 32 bp, Homo sapiens
acacacaccccacaggcacacagggtcaagaa

SEQ ID NO: 11236 - DNA, 32 bp, Homo sapiens
gctctatcacccaggctggagtgcagtggtgc

SEQ ID NO: 11237 - DNA, 30 bp, Homo sapiens
ctagtgttgcccaggctggagtgcagtggc

SEQ ID NO: 11238 - DNA, 32 bp, Homo sapiens
gctctgtcacccaagctggagtgcagtggtgc

SEQ ID NO: 11239 - DNA, 32 bp, Homo sapiens
ctctgtccctcaggctggagtgcagtagcgtg

SEQ ID NO: 11240 - DNA, 32 bp, Homo sapiens
gaaggacacggtgatggatgtactatgtctga

SEQ ID NO: 11241 - DNA, 32 bp, Homo sapiens
gtcttcggacaacaggtagttctaatttctta

SEQ ID NO: 11242 - DNA, 32 bp, Homo sapiens
cactgttcttgcacctgctcctagccctgaac

SEQ ID NO: 11243 - DNA, 32 bp, Homo sapiens
aaccttcacctccaggttcaagtgattctcct

SEQ ID NO: 11244 - DNA, 32 bp, Homo sapiens
acctccgtctcccaggttcaagcgattctctt

SEQ ID NO: 11245 - DNA, 32 bp, Homo sapiens
tctcttgcttcctcttctcttctcccttatcg

SEQ ID NO: 11246 - DNA, 28 bp, Homo sapiens
gcatcctaacttgctgccttatcgtctg

SEQ ID NO: 11247 - DNA, 32 bp, Homo sapiens
gagccctagaggtcgaggctgcagtgagctat

SEQ ID NO: 11248 - DNA, 32 bp, Homo sapiens
actctgttgcccaggctggaatgcagtggtac

SEQ ID NO: 11249 - DNA, 32 bp, Homo sapiens
tgtgggcttgtgttttgtcactgtgaaggggg

SEQ ID NO: 11250 - DNA, 32 bp, Homo sapiens
ccatcattcatcccttaacaggcacattagat

SEQ ID NO: 11251 - DNA, 32 bp, Homo sapiens
agcctcctgaaaagctgggattacagggccct

SEQ ID NO: 11252 - DNA, 32 bp, Homo sapiens
aactctgcctaccaggttcaagcgattctcct

SEQ ID NO: 11253 - DNA, 32 bp, Homo sapiens
gaaatgtacaagccctggatttgctacagagt

SEQ ID NO: 11254 - DNA, 32 bp, Homo sapiens
attattgctgttgcttgaatagcaatagcatg

SEQ ID NO: 11255 - DNA, 32 bp, Homo sapiens
gatgtggggcctgggacttctccagaagctta

SEQ ID NO: 11256 - DNA, 16 bp, Homo sapiens
gccaccacgcccagga

SEQ ID NO: 11257 - DNA, 17 bp, Homo sapiens
caaatgcaagcatcttc

SEQ ID NO: 11258 - DNA, 32 bp, Homo sapiens
accacagtccaaggagctcaccctgggcaacc

SEQ ID NO: 11259 - DNA, 32 bp, Homo sapiens
ttgaggtggagtttcgctcttgttgcccgggc

SEQ ID NO: 11260 - DNA, 32 bp, Homo sapiens
cctttgccgccctcgtcaggcccagctctcct

SEQ ID NO: 11261 - DNA, 32 bp, Homo sapiens
gaagtctctcccagtcaggaggcacaggggtc

SEQ ID NO: 11262 - DNA, 32 bp, Homo sapiens
cgaggggcagcacagggtggtgcagtgggtga

SEQ ID NO: 11263 - DNA, 32 bp, Homo sapiens
aggaggaggactgagcttatctgactccagag

SEQ ID NO: 11264 - DNA, 32 bp, Homo sapiens
gagggtgcagaacgaaccactcgaaaacgagt

SEQ ID NO: 11265 - DNA, 32 bp, Homo sapiens
tgaaacattattcaggctgataagctaagtgc

SEQ ID NO: 11266 - DNA, 32 bp, Homo sapiens
gaacccaggagtcggaggttgcagtgagttga

SEQ ID NO: 11267 - DNA, 32 bp, Homo sapiens
gtctactgctcaggctctcccacttcgtggca

SEQ ID NO: 11268 - DNA, 32 bp, Homo sapiens
acagggtctacaacacgatgccatggctgacg

SEQ ID NO: 11269 - DNA, 32 bp, Homo sapiens
acggaagagccagcaggagcagcgtggtcatt

SEQ ID NO: 11270 - DNA, 32 bp, Homo sapiens
ctctgggttcaagcaattcttctgcctcagcc

SEQ ID NO: 11271 - DNA, 32 bp, Homo sapiens
ctttatctgtcagcttctccctgccacttcac

SEQ ID NO: 11272 - DNA, 32 bp, Homo sapiens
actctgttgcccaggctggagttcagcggtgc

SEQ ID NO: 11273 - DNA, 32 bp, Homo sapiens
tgtctggggtgaatggaatgagctggagcttg

SEQ ID NO: 11274 - DNA, 21 bp, Homo sapiens
ctgcctgtgtgtgtgcaagtg

SEQ ID NO: 11275 - DNA, 32 bp, Homo sapiens
ccgtgctctaccaagatccccacgcggggccc

SEQ ID NO: 11276 - DNA, 32 bp, Homo sapiens
gaacccgggaggcggagcttgcagtgagcgga

SEQ ID NO: 11277 - DNA, 32 bp, Homo sapiens
gaacccgggaggcagagcttgcagtgagcaga

SEQ ID NO: 11278 - DNA, 32 bp, Homo sapiens
gagccagcgatcctgaactgtgttcctgccca

SEQ ID NO: 11279 - DNA, 32 bp, Homo sapiens
tcaattgtcctggctgattatgcatcactctg

SEQ ID NO: 11280 - DNA, 32 bp, Homo sapiens
agttcacattggagaaaagccttactgtactg

SEQ ID NO: 11281 - DNA, 32 bp, Homo sapiens
acctcctcgagtgccctgggaccactgggcca

SEQ ID NO: 11282 - DNA, 32 bp, Homo sapiens
ctcttgtccaggctggaggagtgcagtcgtac

SEQ ID NO: 11283 - DNA, 32 bp, Homo sapiens
gctcccttgggctggagctgcagtaccgtacc

SEQ ID NO: 11284 - DNA, 32 bp, Homo sapiens
ttgttaaattaatgccaaaatattttaatttt

SEQ ID NO: 11285 - DNA, 32 bp, Homo sapiens
tgcagtgctcaataaggcagtgcagtgctcag

SEQ ID NO: 11286 - DNA, 32 bp, Homo sapiens
gctttgtcaccaggctggagtgcagtggtgca

SEQ ID NO: 11287 - DNA, 32 bp, Homo sapiens
ctctgtctcccaggctggagtgcagtggcatg

SEQ ID NO: 11288 - DNA, 32 bp, Homo sapiens
gtttgttgcccaggctggagtgagtggcacag

SEQ ID NO: 11289 - DNA, 32 bp, Homo sapiens
gtcctcactgaagcttctctctctggagcctg

SEQ ID NO: 11290 - DNA, 28 bp, Homo sapiens
ccccgcgtagccgctgcctcctcctacc

SEQ ID NO: 11291 - DNA, 32 bp, Homo sapiens
ctctgtctcccaggttggagtgcagtggcacg

SEQ ID NO: 11292 - DNA, 32 bp, Homo sapiens
cttttgtcacccaggctggagtgccatggcac

SEQ ID NO: 11293 - DNA, 32 bp, Homo sapiens
actggaaaccagcactgtcagcactttgagcc

SEQ ID NO: 11294 - DNA, 20 bp, Homo sapiens
gcctgtaatcccagtacttt

SEQ ID NO: 11295 - DNA, 32 bp, Homo sapiens
aactgctggagggtgaggagatccggctgtgt

SEQ ID NO: 11296 - DNA, 32 bp, Homo sapiens
actttgctcccaggctggaatgcagtggctat

SEQ ID NO: 11297 - DNA, 32 bp, Homo sapiens
ccgagggccttggctgggtcccagaaattccc

SEQ ID NO: 11298 - DNA, 32 bp, Homo sapiens
cacactcctatctctgcacttctgccctccat

SEQ ID NO: 11299 - DNA, 32 bp, Homo sapiens
agagaatatatttttcccatctgtattgttct

SEQ ID NO: 11300 - DNA, 32 bp, Homo sapiens
tggagtgaaattccacgccaggcacagaattt

SEQ ID NO: 11301 - DNA, 17 bp, Homo sapiens
ccatcacttgcccagag

SEQ ID NO: 11302 - DNA, 32 bp, Homo sapiens
gcagccccgggcagcatctcccagaggctccg

SEQ ID NO: 11303 - DNA, 32 bp, Homo sapiens
gagacctcagttctgtgtgtctctagaggtcc

SEQ ID NO: 11304 - DNA, 32 bp, Homo sapiens
gccactgcgtccggtccatctgacttctcaaa

SEQ ID NO: 11305 - DNA, 32 bp, Homo sapiens
agtcatgaacaacactgagaaacgtcaaagtg

SEQ ID NO: 11306 - DNA, 32 bp, Homo sapiens
gaactcagaaggtggaggttgcagtgaggcga

SEQ ID NO: 11307 - DNA, 32 bp, Homo sapiens
ggggtctgctcctgtggcggtgcagtggcaaa

SEQ ID NO: 11308 - DNA, 32 bp, Homo sapiens
ataagaaatgttctcgacagcaagttgaaagc

SEQ ID NO: 11309 - DNA, 32 bp, Homo sapiens
tcctgacagagcacctgctgtttttatgaagc

SEQ ID NO: 11310 - DNA, 32 bp, Homo sapiens
acatccacctcctgggttcaagcgattctcct

SEQ ID NO: 11311 - DNA, 28 bp, Homo sapiens
gtttgcatcaatgctgccttgttattct

SEQ ID NO: 11312 - DNA, 32 bp, Homo sapiens
cagacatacctgcagctttggctctttggtat

SEQ ID NO: 11313 - DNA, 32 bp, Homo sapiens
tgggactgcccagggaggaggccttggaagag

SEQ ID NO: 11314 - DNA, 32 bp, Homo sapiens
ctctgttgcccaggttggagtacagcaatgcc

SEQ ID NO: 11315 - DNA, 32 bp, Homo sapiens
tgagcacgtcttctccaacctggagcctgcca

SEQ ID NO: 11316 - DNA, 22 bp, Homo sapiens
tcaggcctgtaatcccagcact

SEQ ID NO: 11317 - DNA, 32 bp, Homo sapiens
ccgggttcaagcagtttcctgcttcagacttc

SEQ ID NO: 11318 - DNA, 32 bp, Homo sapiens
aagaagaataagcaagaaagaaaagaaggaag

SEQ ID NO: 11319 - DNA, 32 bp, Homo sapiens
ccccaacagccagcagcagtggccctcatcac

SEQ ID NO: 11320 - DNA, 32 bp, Homo sapiens
agctgcttgagagacatcacctggagaagaag

SEQ ID NO: 11321 - DNA, 32 bp, Homo sapiens
ggtttggcctccatcctcatctctcttgggcc

SEQ ID NO: 11322 - DNA, 32 bp, Homo sapiens
gaacccgggaggcagaggttgcattgagccga

SEQ ID NO: 11323 - DNA, 32 bp, Homo sapiens
ctctgtcacccaggctggagtaccggtggtgg

SEQ ID NO: 11324 - DNA, 32 bp, Homo sapiens
acatttaatgttcttggcctctgcttttatgt

SEQ ID NO: 11325 - DNA, 23 bp, Homo sapiens
ctgttgccaggctagagtgcagt

SEQ ID NO: 11326 - DNA, 32 bp, Homo sapiens
gtctgttgcccaggctggagtgcagtggcgcg

SEQ ID NO: 11327 - DNA, 32 bp, Homo sapiens
gaacccgtgaggcagaggttgcagtgagccga

SEQ ID NO: 11328 - DNA, 32 bp, Homo sapiens
ttaccgcatcttctcagcagcttctgaccact

SEQ ID NO: 11329 - DNA, 32 bp, Homo sapiens
taaaataaatgtaatttatctttgccaaaacc

SEQ ID NO: 11330 - DNA, 32 bp, Homo sapiens
atatcagatatctttatatagcacttttatgt

SEQ ID NO: 11331 - DNA, 32 bp, Homo sapiens
ctgtctgaatcctgaacacaggcaccaggact

SEQ ID NO: 11332 - DNA, 32 bp, Homo sapiens
tctcctctcctctcttcttgtttgaacatggt

SEQ ID NO: 11333 - DNA, 23 bp, Homo sapiens
ctgtcaccaggccggagtgcagt

SEQ ID NO: 11334 - DNA, 32 bp, Homo sapiens
aaactttgcttcaggctgggtagtggtagagg

SEQ ID NO: 11335 - DNA, 32 bp, Homo sapiens
ttttaaggcttagaggaacttgagttaggatc

SEQ ID NO: 11336 - DNA, 32 bp, Homo sapiens
gctctgtcacccaggctggagtgcaatggcgt

SEQ ID NO: 11337 - DNA, 32 bp, Homo sapiens
ggctggcctctctggctgggtgcagtgaatgg

SEQ ID NO: 11338 - DNA, 32 bp, Homo sapiens
tgtagagcaagcacgttttccacctcactgtc

SEQ ID NO: 11339 - DNA, 28 bp, Homo sapiens
gaattttcaagtgctgttttgttggaag

SEQ ID NO: 11340 - DNA, 32 bp, Homo sapiens
gcctcggacaggcagaggctgtgaaatacgtg

SEQ ID NO: 11341 - DNA, 32 bp, Homo sapiens
atcctttaagtctgcttaattacttgaaaatt

SEQ ID NO: 11342 - DNA, 32 bp, Homo sapiens
gcttctatggggctctctcttctgccttctca

SEQ ID NO: 11343 - DNA, 32 bp, Homo sapiens
ccagactcaagccatcctcccacctcaacctc

SEQ ID NO: 11344 - DNA, 32 bp, Homo sapiens
ggtactgcagaacagagcctgcagtgagacac

SEQ ID NO: 11345 - DNA, 32 bp, Homo sapiens
aactctgtgctgctgggtggaagctttatagt

SEQ ID NO: 11346 - DNA, 32 bp, Homo sapiens
gactgtcacttgctgttacaggcacaggtgat

SEQ ID NO: 11347 - DNA, 32 bp, Homo sapiens
gctttgtcgccctggctggagtgcagttgcgc

SEQ ID NO: 11348 - DNA, 32 bp, Homo sapiens
ttttgatatttctagcttatctacttccaaac

SEQ ID NO: 11349 - DNA, 32 bp, Homo sapiens
ctgactgcagaactgccgctctcagtggacag

SEQ ID NO: 11350 - DNA, 28 bp, Homo sapiens
tgtgcctctcatgctgcctcctctgccc

SEQ ID NO: 11351 - DNA, 32 bp, Homo sapiens
tgtgtgtccagagtgagcaaggattatgtttt

SEQ ID NO: 11352 - DNA, 32 bp, Homo sapiens
gaacccaggaggtagaggctgcagtgagcagg

SEQ ID NO: 11353 - DNA, 32 bp, Homo sapiens
cggatgtggagaggagaatggaaatcgcagaa

SEQ ID NO: 11354 - DNA, 32 bp, Homo sapiens
cccttgaggctggggagctccactccttggct

SEQ ID NO: 11355 - DNA, 32 bp, Homo sapiens
acctccacttcccgggttcaagcgattcttct

SEQ ID NO: 11356 - DNA, 21 bp, Homo sapiens
tttattggtctgttcctttgg

SEQ ID NO: 11357 - DNA, 24 bp, Homo sapiens
tcatacttgtaatccctgcacttt

SEQ ID NO: 11358 - DNA, 25 bp, Homo sapiens
gcaggaaagggaaaaggagagtagt

SEQ ID NO: 11359 - DNA, 32 bp, Homo sapiens
gctctattggccaggctggagtgtagtggcac

SEQ ID NO: 11360 - DNA, 32 bp, Homo sapiens
cgggcagtgttagaggaggagatgggagcggt

SEQ ID NO: 11361 - DNA, 32 bp, Homo sapiens
gctctttcgcccaggctggagtgcaatggtgt

SEQ ID NO: 11362 - DNA, 32 bp, Homo sapiens
tttgtgagtcaatacatagtgctgctgtgtgc

SEQ ID NO: 11363 - DNA, 32 bp, Homo sapiens
gctgaggactgcacgccgctgtgcggaagccc

SEQ ID NO: 11364 - DNA, 32 bp, Homo sapiens
acctccgcctcctgggttcaagcgattctcca

SEQ ID NO: 11365 - DNA, 32 bp, Homo sapiens
ttagtgcctagagttaagagacaaatgtttac

SEQ ID NO: 11366 - DNA, 32 bp, Homo sapiens
accttgtccaaccagctacccacctcaactcc

SEQ ID NO: 11367 - DNA, 32 bp, Homo sapiens
tcacctagcttgccacaaaaattctttggcga

SEQ ID NO: 11368 - DNA, 32 bp, Homo sapiens
agcctcctgagtagttgggattacagatgccc

SEQ ID NO: 11369 - DNA, 32 bp, Homo sapiens
ttagtcaggctatcctgacaagacttgaccta

SEQ ID NO: 11370 - DNA, 32 bp, Homo sapiens
attaaaattttgggtcagactttgccataatg

SEQ ID NO: 11371 - DNA, 32 bp, Homo sapiens
ctggcctcaggtgatccacccacctcagtgtt

SEQ ID NO: 11372 - DNA, 18 bp, Homo sapiens
ctcaactcccctcgggca

SEQ ID NO: 11373 - DNA, 32 bp, Homo sapiens
ggcagtctgtagagcagctcccagaggctgcc

SEQ ID NO: 11374 - DNA, 32 bp, Homo sapiens
actgatggcctgtcctggatgccaggcacttg

SEQ ID NO: 11375 - DNA, 32 bp, Homo sapiens
gtctaaagaagaggtgagagcaaaaggaataa

SEQ ID NO: 11376 - DNA, 32 bp, Homo sapiens
actatatcatgggctctgcagaacatatcaaa

SEQ ID NO: 11377 - DNA, 22 bp, Homo sapiens
cccagcctctcctccttgggca

SEQ ID NO: 11378 - DNA, 32 bp, Homo sapiens
tagtataaaacacaggctttcacaaattttgt

SEQ ID NO: 11379 - DNA, 32 bp, Homo sapiens
ccgatggggaggcagcccccgcagtggacagc

SEQ ID NO: 11380 - DNA, 32 bp, Homo sapiens
cttacaaactaaatcagtgtgctgctagaggg

SEQ ID NO: 11381 - DNA, 32 bp, Homo sapiens
ctgcatcgcatcctgaagctcagcctgcctac

SEQ ID NO: 11382 - DNA, 32 bp, Homo sapiens
tactatctaacaacagtcttgcacctaaagac

SEQ ID NO: 11383 - DNA, 32 bp, Homo sapiens
gggtgggtatccagatggtcccatgagtaggg

SEQ ID NO: 11384 - DNA, 32 bp, Homo sapiens
gtattgaactcctggcctcaagcaatcctccc

SEQ ID NO: 11385 - DNA, 32 bp, Homo sapiens
tacaagagaagaggaagggagcagagagcact

SEQ ID NO: 11386 - DNA, 32 bp, Homo sapiens
agtctcccgagtagctgggattataggcgccc

SEQ ID NO: 11387 - DNA, 32 bp, Homo sapiens
ccactgctaacaacaggactgcctttccctgg

SEQ ID NO: 11388 - DNA, 32 bp, Homo sapiens
ctcaggctcccaggagcttccactctcagacc

SEQ ID NO: 11389 - DNA, 24 bp, Homo sapiens
ttcactgttgatgtgtttgtttgg

SEQ ID NO: 11390 - DNA, 32 bp, Homo sapiens
cccataattaaaacatgatcacttttacacag

SEQ ID NO: 11391 - DNA, 32 bp, Homo sapiens
tgctctgtcgccagactggagtgcagtggcgc

SEQ ID NO: 11392 - DNA, 22 bp, Homo sapiens
cagggctgcctccctccagccc

SEQ ID NO: 11393 - DNA, 32 bp, Homo sapiens
tcttggtgttgcatgctcacaactctgctgac

SEQ ID NO: 11394 - DNA, 32 bp, Homo sapiens
cagccgatggacttggcttcaagctcagattt

SEQ ID NO: 11395 - DNA, 32 bp, Homo sapiens
ctgcatcccatcctgaatatcctttgcaactc

SEQ ID NO: 11396 - DNA, 32 bp, Homo sapiens
cccttgggccctgcctggagtgtgtgccgcct

SEQ ID NO: 11397 - DNA, 32 bp, Homo sapiens
gccacagcctccacaccagatctccacattgt

SEQ ID NO: 11398 - DNA, 32 bp, Homo sapiens
tccagcaatttccaaaagctggagctgtgtaa

SEQ ID NO: 11399 - DNA, 32 bp, Homo sapiens
tcagattcaagcaattctcctgcctcagcctc

SEQ ID NO: 11400 - DNA, 32 bp, Homo sapiens
agctgcgtcagacaacgacccacctcatcccc

SEQ ID NO: 11401 - DNA, 32 bp, Homo sapiens
aaggaagcagcatcctggacccttgaggccct

SEQ ID NO: 11402 - DNA, 20 bp, Homo sapiens
tgtggggctggagagatggg

SEQ ID NO: 11403 - DNA, 24 bp, Homo sapiens
tcatgcctgtaatccgagcacttt

SEQ ID NO: 11404 - DNA, 32 bp, Homo sapiens
acggagttgcccaggctggagtgcagcgcatg

SEQ ID NO: 11405 - DNA, 32 bp, Homo sapiens
cacgtcgtgctgctgctggaagccaacagcct

SEQ ID NO: 11406 - DNA, 32 bp, Homo sapiens
ccagaaagagcctcttgtaacaagtattcaaa

SEQ ID NO: 11407 - DNA, 32 bp, Homo sapiens
gaaccctggaggcggaggttgcagtgagtgga

SEQ ID NO: 11408 - DNA, 32 bp, Homo sapiens
gtatagaatgttcttggaagctccattgattt

SEQ ID NO: 11409 - DNA, 32 bp, Homo sapiens
acccttgaacaacacaggttagagctgcatat

SEQ ID NO: 11410 - DNA, 32 bp, Homo sapiens
gaaccctggaggttgaggttgcagtgagctga

SEQ ID NO: 11411 - DNA, 32 bp, Homo sapiens
caacctcggaggcggaggttgcagtgagccaa

SEQ ID NO: 11412 - DNA, 32 bp, Homo sapiens
gaacctaggaggggaaggttgcagtgagccga

SEQ ID NO: 11413 - DNA, 32 bp, Homo sapiens
gggttatatctggcttctctccagacctgctt

SEQ ID NO: 11414 - DNA, 32 bp, Homo sapiens
aaagaaagaaagaaagaaagaaagaaaagaaa

SEQ ID NO: 11415 - DNA, 32 bp, Homo sapiens
gacctgagacactgatgaatggtgctattttg

SEQ ID NO: 11416 - DNA, 32 bp, Homo sapiens
agcacggggcccaggctagagtgcagtggcgt

SEQ ID NO: 11417 - DNA, 32 bp, Homo sapiens
gagggagccagacctctggcccagaaagccag

SEQ ID NO: 11418 - DNA, 32 bp, Homo sapiens
ctccccaggctcatgtgccaccaccttccctc

SEQ ID NO: 11419 - DNA, 21 bp, Homo sapiens
gacagaaagctgtgccgccac

SEQ ID NO: 11420 - DNA, 32 bp, Homo sapiens
aactatcacctgggctggagtgcgatggcatg

SEQ ID NO: 11421 - DNA, 32 bp, Homo sapiens
ggccagaagtaccaggtgccccatgaagtgct

SEQ ID NO: 11422 - DNA, 32 bp, Homo sapiens
ctggctgaatcctgaggccactgtgaatttgc

SEQ ID NO: 11423 - DNA, 32 bp, Homo sapiens
gaaagtaactgcagtgatgaacattttggtcc

SEQ ID NO: 11424 - DNA, 32 bp, Homo sapiens
gtctcactcctgtaataccagcactttgggag

SEQ ID NO: 11425 - DNA, 32 bp, Homo sapiens
gctctgtcactgaggctggagtgcagtggcgc

SEQ ID NO: 11426 - DNA, 32 bp, Homo sapiens
gctctgttgcccaggttagagtgcagtggctt

SEQ ID NO: 11427 - DNA, 32 bp, Homo sapiens
cactcttatcagcttagagtgttcaactgatc

SEQ ID NO: 11428 - DNA, 32 bp, Homo sapiens
ggaccctggaggtagaggctgcagtgagccaa

SEQ ID NO: 11429 - DNA, 24 bp, Homo sapiens
catattagattactaagtcatttg

SEQ ID NO: 11430 - DNA, 32 bp, Homo sapiens
cccagacatcacctttcattctggacctacca

SEQ ID NO: 11431 - DNA, 32 bp, Homo sapiens
tgtaaagactgaagcatccccacctcaggatt

SEQ ID NO: 11432 - DNA, 32 bp, Homo sapiens
gcctccaactctctggttcaagcgattctcct

SEQ ID NO: 11433 - DNA, 32 bp, Homo sapiens
cctgagccacctcagggatacagggtccccca

SEQ ID NO: 11434 - DNA, 32 bp, Homo sapiens
attggatgagctgcaggaaaatggcaggcagg

SEQ ID NO: 11435 - DNA, 32 bp, Homo sapiens
ggctaggtccctctgtccatctgggcctttgt

SEQ ID NO: 11436 - DNA, 32 bp, Homo sapiens
actttgttgcccaggctggagtgcagtggtct

SEQ ID NO: 11437 - DNA, 18 bp, Homo sapiens
caggtggcgttccagccc

SEQ ID NO: 11438 - DNA, 32 bp, Homo sapiens
aaagtgtatctgctgctcctagggccatgctt

SEQ ID NO: 11439 - DNA, 32 bp, Homo sapiens
atcccagcctccattcaccatgtgcttccgtg

SEQ ID NO: 11440 - DNA, 32 bp, Homo sapiens
tttctccttaaccttggggtcatggttcagca

SEQ ID NO: 11441 - DNA, 32 bp, Homo sapiens
ctggttcacattcagctccagtgcagttcaag

SEQ ID NO: 11442 - DNA, 32 bp, Homo sapiens
gcattttgtaccatctgctccccaatggccaa

SEQ ID NO: 11443 - DNA, 29 bp, Homo sapiens
ggagatgagcacgaagaaagaagacagta

SEQ ID NO: 11444 - DNA, 24 bp, Homo sapiens
tgacgtgatctcggctcactgcag

SEQ ID NO: 11445 - DNA, 20 bp, Homo sapiens
tctctgtccagttcattttc

SEQ ID NO: 11446 - DNA, 32 bp, Homo sapiens
gcactgtctcccaggctggactgcagcagcgc

SEQ ID NO: 11447 - DNA, 32 bp, Homo sapiens
ttttgcccaggctggatggagtgcagtggcgt

SEQ ID NO: 11448 - DNA, 32 bp, Homo sapiens
gtcgcctgtcaacggctagagtgcagtagcgt

SEQ ID NO: 11449 - DNA, 32 bp, Homo sapiens
gtggtgagcacaccatttgtgctgctgctgtt

SEQ ID NO: 11450 - DNA, 19 bp, Homo sapiens
cctgtactcccagcacttt

SEQ ID NO: 11451 - DNA, 32 bp, Homo sapiens
gggcctgggaattggccatgtgttaatttatt

SEQ ID NO: 11452 - DNA, 32 bp, Homo sapiens
gaacccggcaggcagagcttgcagtgagccga

SEQ ID NO: 11453 - DNA, 32 bp, Homo sapiens
gcattcatgtttctccccaccttatccccatc

SEQ ID NO: 11454 - DNA, 19 bp, Homo sapiens
cccctgccccttgttggta

SEQ ID NO: 11455 - DNA, 24 bp, Homo sapiens
tcacacctttaatcccagcacttt

SEQ ID NO: 11456 - DNA, 29 bp, Homo sapiens
aaatcaagtctatgtaagcttacttgaaa

SEQ ID NO: 11457 - DNA, 32 bp, Homo sapiens
cggaagcagctttggctggtggtggctggcat

SEQ ID NO: 11458 - DNA, 21 bp, Homo sapiens
tgtggcctgaagggatgggga

SEQ ID NO: 11459 - DNA, 32 bp, Homo sapiens
agggtgttgcccatgcttttgggtgggtccca

SEQ ID NO: 11460 - DNA, 32 bp, Homo sapiens
tatcgatagcccaggcaggagtacagtggcac

SEQ ID NO: 11461 - DNA, 32 bp, Homo sapiens
gcacagctgctgctgacaggtctacctgaagt

SEQ ID NO: 11462 - DNA, 32 bp, Homo sapiens
gaacccaggaggcagagcttgcagtgagctga

SEQ ID NO: 11463 - DNA, 32 bp, Homo sapiens
gaacctgggaggcagagcttgcagtgagccaa

SEQ ID NO: 11464 - DNA, 32 bp, Homo sapiens
ctcttgttgcccaggctggagggcaatggtgc

SEQ ID NO: 11465 - DNA, 32 bp, Homo sapiens
ccacagacccctgggagcttccgctttgaaag

SEQ ID NO: 11466 - DNA, 32 bp, Homo sapiens
ctactcgggaggctgaggaaggagaatggtgt

SEQ ID NO: 11467 - DNA, 32 bp, Homo sapiens
gaacccgggaggcagagcttgtggtgagccga

SEQ ID NO: 11468 - DNA, 32 bp, Homo sapiens
aaagcattcattctccccatttgtgacatttg

SEQ ID NO: 11469 - DNA, 22 bp, Homo sapiens
catgcctgttatcccagcactt

SEQ ID NO: 11470 - DNA, 32 bp, Homo sapiens
gttcagagatccaggcctcccacctcagactc

SEQ ID NO: 11471 - DNA, 32 bp, Homo sapiens
gggcagcagctgctgccacagcctccagcggc

SEQ ID NO: 11472 - DNA, 24 bp, Homo sapiens
ctgtggcccaggctggagtgcagt

SEQ ID NO: 11473 - DNA, 32 bp, Homo sapiens
attttgtttaaaacatgattatcttaattcct

SEQ ID NO: 11474 - DNA, 32 bp, Homo sapiens
actctgttgcccaaggtagagtgcagtggcgt

SEQ ID NO: 11475 - DNA, 32 bp, Homo sapiens
ccagaaaagaagtcttaagatatttcaaggaa

SEQ ID NO: 11476 - DNA, 32 bp, Homo sapiens
acattgattcactggcgtctgttttcatttta

SEQ ID NO: 11477 - DNA, 32 bp, Homo sapiens
ggcacgtccacaggctgggtcgcgaggtggcg

SEQ ID NO: 11478 - DNA, 32 bp, Homo sapiens
acctcggccccagtgatggctgatctcactcc

SEQ ID NO: 11479 - DNA, 32 bp, Homo sapiens
cgccggggaagaggaggaggaaggaaagaaag

SEQ ID NO: 11480 - DNA, 32 bp, Homo sapiens
agggaaagaggcttgggaagaaaacagcagaa

SEQ ID NO: 11481 - DNA, 32 bp, Homo sapiens
acctctgcttcccgggttcaagtgattctcct

SEQ ID NO: 11482 - DNA, 18 bp, Homo sapiens
gatcgaggacttccgggg

SEQ ID NO: 11483 - DNA, 24 bp, Homo sapiens
tcgcacctgtaatcccagcacttt

SEQ ID NO: 11484 - DNA, 24 bp, Homo sapiens
tcacacctgtgatcccagcacttt

SEQ ID NO: 11485 - DNA, 32 bp, Homo sapiens
cactctgtcgccaggctggaatgcagtagggc

SEQ ID NO: 11486 - DNA, 32 bp, Homo sapiens
attctgtcacacagtctggagtgctgtggtgc

SEQ ID NO: 11487 - DNA, 32 bp, Homo sapiens
gacatcctacacttcaggattacttgactatc

SEQ ID NO: 11488 - DNA, 32 bp, Homo sapiens
tgaccatagaggcagagattggagtgaagtgg

SEQ ID NO: 11489 - DNA, 20 bp, Homo sapiens
gcccctccactctgcccagg

SEQ ID NO: 11490 - DNA, 28 bp, Homo sapiens
ctttcttaattagctgcctcaccggctg

SEQ ID NO: 11491 - DNA, 28 bp, Homo sapiens
tgcaacccaagtggccttatccgtgcag

SEQ ID NO: 11492 - DNA, 32 bp, Homo sapiens
gtagaggcttcatatgagacccagaaagtcta

SEQ ID NO: 11493 - DNA, 32 bp, Homo sapiens
actgcggccacagcttctgcctcaggtgcatc

SEQ ID NO: 11494 - DNA, 17 bp, Homo sapiens
gcccccctggctccagg

SEQ ID NO: 11495 - DNA, 24 bp, Homo sapiens
tggcacaatcacagttcactgcag

SEQ ID NO: 11496 - DNA, 23 bp, Homo sapiens
tggcatgatcatggctcactgca

SEQ ID NO: 11497 - DNA, 32 bp, Homo sapiens
ctgcgccgtccctcgttccatggcccagtcct

SEQ ID NO: 11498 - DNA, 32 bp, Homo sapiens
gctctgttggccaggctggagtgcagtgttcg

SEQ ID NO: 11499 - DNA, 32 bp, Homo sapiens
gatgcgttcagcagactggtttgcagtgaatt

SEQ ID NO: 11500 - DNA, 32 bp, Homo sapiens
tgtgtaccttttctgtcatattcagaaaccgt

SEQ ID NO: 11501 - DNA, 32 bp, Homo sapiens
tcttgtcacctaggccagagtgcagtgtcatg

SEQ ID NO: 11502 - DNA, 32 bp, Homo sapiens
agatacgcagccattccatattcatctccaac

SEQ ID NO: 11503 - DNA, 32 bp, Homo sapiens
gccactgcctcccaggttcaagtgattctcct

SEQ ID NO: 11504 - DNA, 32 bp, Homo sapiens
ttaaaagcagttcaagttgacaacagcagaaa

SEQ ID NO: 11505 - DNA, 32 bp, Homo sapiens
agcctcaggaggttgaggctgcagtgagctgt

SEQ ID NO: 11506 - DNA, 32 bp, Homo sapiens
ctccgcttcccaggctggggtgcagtggtgcg

SEQ ID NO: 11507 - DNA, 32 bp, Homo sapiens
ttttattgcccaggcagtgctctgggcaggaa

SEQ ID NO: 11508 - DNA, 32 bp, Homo sapiens
ctctgccagccagactggagtgcattggcgag

SEQ ID NO: 11509 - DNA, 32 bp, Homo sapiens
tcttgatctgcagcttctctgaagtttggaaa

SEQ ID NO: 11510 - DNA, 32 bp, Homo sapiens
tcccacttcctcagccccatctgtccctccat

SEQ ID NO: 11511 - DNA, 32 bp, Homo sapiens
cttcgtgggtttccctggcaggcttgatggca

SEQ ID NO: 11512 - DNA, 32 bp, Homo sapiens
gctctgtcacccagactggaacacagtggcac

SEQ ID NO: 11513 - DNA, 32 bp, Homo sapiens
ccacgatcacccagcaggagtcgtggcagaac

SEQ ID NO: 11514 - DNA, 32 bp, Homo sapiens
catgtcccagaacttagcctttacctgtgaag

SEQ ID NO: 11515 - DNA, 32 bp, Homo sapiens
atgtacagaacacatttctctgatctccataa

SEQ ID NO: 11516 - DNA, 32 bp, Homo sapiens
tggccagcctccagctcctcagacctcctggg

SEQ ID NO: 11517 - DNA, 32 bp, Homo sapiens
gaatgccttacctgggttctgggcagttcttc

SEQ ID NO: 11518 - DNA, 32 bp, Homo sapiens
tagggtgggaggcagggcaatgcaggatccaa

SEQ ID NO: 11519 - DNA, 32 bp, Homo sapiens
ctctatcacccaagctggagtacagtggcaca

SEQ ID NO: 11520 - DNA, 32 bp, Homo sapiens
ctctgtcgcccaggctggagtgcggtggcgca

SEQ ID NO: 11521 - DNA, 32 bp, Homo sapiens
ctctgtcacccagactggagtgcagtggcaca

SEQ ID NO: 11522 - DNA, 32 bp, Homo sapiens
ctctgtcgcccaggttggagtgcagtggcgtg

SEQ ID NO: 11523 - DNA, 32 bp, Homo sapiens
ctctgtcgcccaggctggagtgcagtggcgcg

SEQ ID NO: 11524 - DNA, 31 bp, Homo sapiens
cgaggcggcgactgcggtaggagggaagagg

SEQ ID NO: 11525 - DNA, 32 bp, Homo sapiens
ctctgttgcccaggctggagtgcagtggcgtg

SEQ ID NO: 11526 - DNA, 32 bp, Homo sapiens
caggagtgaacaggaacaggaaaacaaatggc

SEQ ID NO: 11527 - DNA, 24 bp, Homo sapiens
agttgttaactaaattaacattgg

SEQ ID NO: 11528 - DNA, 32 bp, Homo sapiens
ctctgtcacccaggctggagtgcagtggcgca

SEQ ID NO: 11529 - DNA, 32 bp, Homo sapiens
cactttgggaggcagaggcgggaggattgctt

SEQ ID NO: 11530 - DNA, 32 bp, Homo sapiens
tgttgtcgcctaggctggagtgcaatgatgcg

SEQ ID NO: 11531 - DNA, 32 bp, Homo sapiens
tgaatctctaccagctgctcccagaatcacag

SEQ ID NO: 11532 - DNA, 32 bp, Homo sapiens
tgacccaggaagcggaggttgcagtgagccaa

SEQ ID NO: 11533 - DNA, 32 bp, Homo sapiens
ctggcctcaggtgatctgcccacctcggcctc

SEQ ID NO: 11534 - DNA, 32 bp, Homo sapiens
aggcccatgtatctgcacgagcacttagcttg

SEQ ID NO: 11535 - DNA, 32 bp, Homo sapiens
tgccttgactgtggcgatgattacatgaaaac

SEQ ID NO: 11536 - DNA, 32 bp, Homo sapiens
tggatttcacccaggaggagtggcagcaactg

SEQ ID NO: 11537 - DNA, 32 bp, Homo sapiens
cccattaaagcatttcaaagagtgctagattc

SEQ ID NO: 11538 - DNA, 32 bp, Homo sapiens
ccaggttcaagcacttctcgtacctcagactc

SEQ ID NO: 11539 - DNA, 22 bp, Homo sapiens
gttgtccaggctggagtgcagt

SEQ ID NO: 11540 - DNA, 16 bp, Homo sapiens
gcccactgtgtctagg

SEQ ID NO: 11541 - DNA, 23 bp, Homo sapiens
tcatgcctgtaatcctaacactt

SEQ ID NO: 11542 - DNA, 32 bp, Homo sapiens
ttagggtttttcaggctgggcacagtgactca

SEQ ID NO: 11543 - DNA, 32 bp, Homo sapiens
caaggggtgctgctggccacactgcactagca

SEQ ID NO: 11544 - DNA, 32 bp, Homo sapiens
ctctgttgcctaggctggagtgcagtgaggca

SEQ ID NO: 11545 - DNA, 32 bp, Homo sapiens
agctgccccagagtgagggtgtagatgtctgt

SEQ ID NO: 11546 - DNA, 32 bp, Homo sapiens
tggaaggaaaggtgactgtgtgatctgattct

SEQ ID NO: 11547 - DNA, 32 bp, Homo sapiens
ccacaataaaggctgagctcttatcttgctgc

SEQ ID NO: 11548 - DNA, 32 bp, Homo sapiens
agcctcccgagtagctgggattgcaggcgccc

SEQ ID NO: 11549 - DNA, 32 bp, Homo sapiens
aactcaagctcctgaactcaagcaattctcct

SEQ ID NO: 11550 - DNA, 32 bp, Homo sapiens
gtataacttaaccttgatttataaggtcttaa

SEQ ID NO: 11551 - DNA, 25 bp, Homo sapiens
atgtgacagagctcgacccaagcca

SEQ ID NO: 11552 - DNA, 32 bp, Homo sapiens
cccgaccatcttctcctatttcctggggagcc

SEQ ID NO: 11553 - DNA, 32 bp, Homo sapiens
ggagccagaagagggaggaaaggagatgagat

SEQ ID NO: 11554 - DNA, 32 bp, Homo sapiens
ctctgcccagttctctgggtcaagctggatgg

SEQ ID NO: 11555 - DNA, 32 bp, Homo sapiens
ggtctcagcattctgtcatactcaacagctat

SEQ ID NO: 11556 - DNA, 32 bp, Homo sapiens
gaacccgggaggcagaggtagtagtgagctga

SEQ ID NO: 11557 - DNA, 32 bp, Homo sapiens
aatattgccattatgcttgacatggtttccaa

SEQ ID NO: 11558 - DNA, 32 bp, Homo sapiens
ctctgacatccaagctggggtgcagtggcgcg

SEQ ID NO: 11559 - DNA, 32 bp, Homo sapiens
acctctgcctcctgggttcaagcaattctcct

SEQ ID NO: 11560 - DNA, 32 bp, Homo sapiens
acctccgcctcctgggttcaagcaattcttct

SEQ ID NO: 11561 - DNA, 32 bp, Homo sapiens
tgaacagggaggcagaggttgcagtgagccga

SEQ ID NO: 11562 - DNA, 32 bp, Homo sapiens
ctctgttgcccaggcagtagtgcagtggcgcg

SEQ ID NO: 11563 - DNA, 32 bp, Homo sapiens
gtcgcccacccaggctggagtacagtggcacg

SEQ ID NO: 11564 - DNA, 32 bp, Homo sapiens
tcactcagatgtattttagataagctatttag

SEQ ID NO: 11565 - DNA, 32 bp, Homo sapiens
gtctctgagaaccattctcccaccccaagttc

SEQ ID NO: 11566 - DNA, 32 bp, Homo sapiens
ggggcagggcctgggcctcatggcttttgctt

SEQ ID NO: 11567 - DNA, 32 bp, Homo sapiens
agcctgccaagtagctgggattacagacaggc

SEQ ID NO: 11568 - DNA, 22 bp, Homo sapiens
tcacccaggctggagtgcagtg

SEQ ID NO: 11569 - DNA, 32 bp, Homo sapiens
taagaccttgggctgcctcttctgtcttaact

SEQ ID NO: 11570 - DNA, 32 bp, Homo sapiens
cttccttttgagggagcaagtccttccctttc

SEQ ID NO: 11571 - DNA, 32 bp, Homo sapiens
tgagcaggagattttgctcttgtgttgagacc

SEQ ID NO: 11572 - DNA, 32 bp, Homo sapiens
agcctagagccaggactgaagcttcaagatgg

SEQ ID NO: 11573 - DNA, 24 bp, Homo sapiens
tggcgagatcatagctcactgcag

SEQ ID NO: 11574 - DNA, 32 bp, Homo sapiens
ctggctctgcccaggtggggtggggtggccca

SEQ ID NO: 11575 - DNA, 32 bp, Homo sapiens
gctctgttgcccaagctggagtgaagtggtac

SEQ ID NO: 11576 - DNA, 32 bp, Homo sapiens
agtttttcatgggcatgattccaaaatcaaca

SEQ ID NO: 11577 - DNA, 32 bp, Homo sapiens
agttttaagaattgttccttggggaaaaattt

SEQ ID NO: 11578 - DNA, 32 bp, Homo sapiens
ttcctcctttgggcatctcttctgcctcccaa

SEQ ID NO: 11579 - DNA, 32 bp, Homo sapiens
cagtgctctgcagaagcctctccccctcacag

SEQ ID NO: 11580 - DNA, 32 bp, Homo sapiens
gaatagataggaggagaaaaacaattacacac

SEQ ID NO: 11581 - DNA, 32 bp, Homo sapiens
actgactagatttattcataccatgagacaac

SEQ ID NO: 11582 - DNA, 22 bp, Homo sapiens
agatgcctcgcagagcaccagg

SEQ ID NO: 11583 - DNA, 23 bp, Homo sapiens
ggtttctagcggtgcctgaggca

SEQ ID NO: 11584 - DNA, 32 bp, Homo sapiens
cctcttttgccaggctggatgctgtcgtctct

SEQ ID NO: 11585 - DNA, 32 bp, Homo sapiens
gcccggtgcccaggctggggccgccaagcagc

SEQ ID NO: 11586 - DNA, 32 bp, Homo sapiens
acctctgcttcctgggttcaagcgattctcct

SEQ ID NO: 11587 - DNA, 28 bp, Homo sapiens
gcaggcaccccagtggcctcatcctagt

SEQ ID NO: 11588 - DNA, 32 bp, Homo sapiens
atggtaccaatcatgaatctttgtttcaggtt

SEQ ID NO: 11589 - DNA, 32 bp, Homo sapiens
agcaagaaagaaaaagacagaaaacaaatgcg

SEQ ID NO: 11590 - DNA, 32 bp, Homo sapiens
gctctgtcacccagactggagtacaatgacac

SEQ ID NO: 11591 - DNA, 32 bp, Homo sapiens
ctctgttgtccaggctggagtgcaatggcagt

SEQ ID NO: 11592 - DNA, 32 bp, Homo sapiens
gctcagttccagtagcagaaccaccttagttg

SEQ ID NO: 11593 - DNA, 32 bp, Homo sapiens
ccagccctcagactggatcttctgcctccaaa

SEQ ID NO: 11594 - DNA, 31 bp, Homo sapiens
cgctgctaaacacactgcaggagggactctg

SEQ ID NO: 11595 - DNA, 32 bp, Homo sapiens
aacactctgggcaccttccactgtgaatgtga

SEQ ID NO: 11596 - DNA, 32 bp, Homo sapiens
gtcgcgctgctgctgcggcgctccaagttcat

SEQ ID NO: 11597 - DNA, 32 bp, Homo sapiens
aagccttttctcagaccttaggcacagcctct

SEQ ID NO: 11598 - DNA, 32 bp, Homo sapiens
attctgttgcccaggctggagtgcagtggtgc

SEQ ID NO: 11599 - DNA, 32 bp, Homo sapiens
gctttgtcacctaagctggagtgcagtgcgcg

SEQ ID NO: 11600 - DNA, 32 bp, Homo sapiens
aatcatctagttctgtcatcttactgaaagga

SEQ ID NO: 11601 - DNA, 32 bp, Homo sapiens
gaaagactgaagaggctggagtgcagtggcgc

SEQ ID NO: 11602 - DNA, 32 bp, Homo sapiens
acaataaggtccaggctgaggtagtctcagat

SEQ ID NO: 11603 - DNA, 32 bp, Homo sapiens
gttctgtcacccaggctggagtgcagtggtgt

SEQ ID NO: 11604 - DNA, 32 bp, Homo sapiens
aaagaaaaatctaggccgggtgcagtggctca

SEQ ID NO: 11605 - DNA, 32 bp, Homo sapiens
tccacggtgacgggtggctctgtggctggtag

SEQ ID NO: 11606 - DNA, 23 bp, Homo sapiens
gatgaggaggcttctatcttgga

SEQ ID NO: 11607 - DNA, 32 bp, Homo sapiens
tcactgcactcaggctggagtgcagtggtacg

SEQ ID NO: 11608 - DNA, 28 bp, Homo sapiens
tcattcccaagtgcccttgtgccctgtt

SEQ ID NO: 11609 - DNA, 32 bp, Homo sapiens
cactgaagcttagaggagtgaaatgttttgag

SEQ ID NO: 11610 - DNA, 21 bp, Homo sapiens
cctccgcctccctctcgggca

SEQ ID NO: 11611 - DNA, 17 bp, Homo sapiens
aggggagctccaagccc

SEQ ID NO: 11612 - DNA, 32 bp, Homo sapiens
tgccagccaacaacaaatgcctgatcttccgg

SEQ ID NO: 11613 - DNA, 32 bp, Homo sapiens
agtatctgaagagtgagagcattcatgtttga

SEQ ID NO: 11614 - DNA, 32 bp, Homo sapiens
cctgcttgcacatgttatctttgcttctgccg

SEQ ID NO: 11615 - DNA, 31 bp, Homo sapiens
tggccccagcagtcccctaggaggggccttg

SEQ ID NO: 11616 - DNA, 21 bp, Homo sapiens
tcatgcctgtaatcctagcac

SEQ ID NO: 11617 - DNA, 32 bp, Homo sapiens
gtcccaagaaatggaggaagaaaacaaagaat

SEQ ID NO: 11618 - DNA, 32 bp, Homo sapiens
gctctgtcacccaggctggagtgcagtgacat

SEQ ID NO: 11619 - DNA, 32 bp, Homo sapiens
ggctagggtacttggcttgctttgctatgtgt

SEQ ID NO: 11620 - DNA, 32 bp, Homo sapiens
aaggaggaggcggggctgcactgtgagcccga

SEQ ID NO: 11621 - DNA, 32 bp, Homo sapiens
gctctgtcacccaggctggaatgcagtggcat

SEQ ID NO: 11622 - DNA, 32 bp, Homo sapiens
actctgtcgcccaggctggaatgcagtggcat

SEQ ID NO: 11623 - DNA, 32 bp, Homo sapiens
ttcttgttgcccaggctgcagtgcaatggcac

SEQ ID NO: 11624 - DNA, 32 bp, Homo sapiens
gaatccaggaggcgaaggttgcagtgagctga

SEQ ID NO: 11625 - DNA, 32 bp, Homo sapiens
attctccccagtagctgggattacaggtgccc

SEQ ID NO: 11626 - DNA, 32 bp, Homo sapiens
gcctccacctcccagtttcaagcaattctcat

SEQ ID NO: 11627 - DNA, 32 bp, Homo sapiens
gaacccgggaggcggatcttgcagtgagcgga

SEQ ID NO: 11628 - DNA, 32 bp, Homo sapiens
tcctggctcaagtgatctcccacttcagcctc

SEQ ID NO: 11629 - DNA, 32 bp, Homo sapiens
ctgacctcaaatgatccacccacctcagtctc

SEQ ID NO: 11630 - DNA, 32 bp, Homo sapiens
agtgtctggtctgggagctcgttaactatgct

SEQ ID NO: 11631 - DNA, 32 bp, Homo sapiens
ccagtccaaaggacagtgtgtcactgtgaact

SEQ ID NO: 11632 - DNA, 32 bp, Homo sapiens
ctgagggaggcagaagaaagaaatccaagcct

SEQ ID NO: 11633 - DNA, 32 bp, Homo sapiens
ctgacctcaagcaattgtcctgcctcctcaac

SEQ ID NO: 11634 - DNA, 32 bp, Homo sapiens
gcaacatggagttcattgtcctgttgcttact

SEQ ID NO: 11635 - DNA, 32 bp, Homo sapiens
ctagccttcctctcttccaaacacaggttccg

SEQ ID NO: 11636 - DNA, 26 bp, Homo sapiens
cctcaaagcttatccagaaccttccc

SEQ ID NO: 11637 - DNA, 32 bp, Homo sapiens
gctgtgttgtccaggctggagtgcagtggtgt

SEQ ID NO: 11638 - DNA, 32 bp, Homo sapiens
ttgcctctatcagggctggagtggtgcagccc

SEQ ID NO: 11639 - DNA, 32 bp, Homo sapiens
tgctctgttgcccagctggagtgcagtggtgt

SEQ ID NO: 11640 - DNA, 32 bp, Homo sapiens
ggactcgcaagtgccctcatcacagccacccc

SEQ ID NO: 11641 - DNA, 32 bp, Homo sapiens
gaacctaggaggcagaagttgcagtgagcaga

SEQ ID NO: 11642 - DNA, 32 bp, Homo sapiens
gacacgaatgcaccttctctttgctaccaaca

SEQ ID NO: 11643 - DNA, 32 bp, Homo sapiens
cggagcccttgagacatccttgagaagagcca

SEQ ID NO: 11644 - DNA, 32 bp, Homo sapiens
ccacggcatcttctcccgagaccacaaacacc

SEQ ID NO: 11645 - DNA, 32 bp, Homo sapiens
ctagcctcaagtgttctgcccacctcagcctt

SEQ ID NO: 11646 - DNA, 22 bp, Homo sapiens
tggcgcgattcagctcactgca

SEQ ID NO: 11647 - DNA, 32 bp, Homo sapiens
aaacaaaggccaaaggtgtatagattgcttga

SEQ ID NO: 11648 - DNA, 32 bp, Homo sapiens
agaccaggactttttatctagagaccagcatg

SEQ ID NO: 11649 - DNA, 32 bp, Homo sapiens
actctgtcgcccaggctggagtgcagtggcgt

SEQ ID NO: 11650 - DNA, 32 bp, Homo sapiens
tttagatggagtttggctcttgtcacccaggc

SEQ ID NO: 11651 - DNA, 32 bp, Homo sapiens
ggcgtgagccaccgcacgtagcatttacatta

SEQ ID NO: 11652 - DNA, 32 bp, Homo sapiens
gctcggtcacctaggctggagtgtagtggcgc

SEQ ID NO: 11653 - DNA, 32 bp, Homo sapiens
gctctgtcacccagactggagtgcagtggcat

SEQ ID NO: 11654 - DNA, 32 bp, Homo sapiens
gctttgtcacccaggctggagtgcagtgtcgt

SEQ ID NO: 11655 - DNA, 32 bp, Homo sapiens
actctgttgcccaggctggagtacagtggcac

SEQ ID NO: 11656 - DNA, 32 bp, Homo sapiens
gtccagtgctccaggctgggggccgtggatcc

SEQ ID NO: 11657 - DNA, 32 bp, Homo sapiens
gttctgtcgtccaggctggagtgcggtggcgt

SEQ ID NO: 11658 - DNA, 32 bp, Homo sapiens
actctgttgcccagactggagtgcagtggcac

SEQ ID NO: 11659 - DNA, 32 bp, Homo sapiens
gctctgtcacccaggctggagtgcagtggcgt

SEQ ID NO: 11660 - DNA, 32 bp, Homo sapiens
tcttgctctcccaggctggagtgcagtggtgt

SEQ ID NO: 11661 - DNA, 32 bp, Homo sapiens
actctgttgcccaggctggagtgcagtggcgc

SEQ ID NO: 11662 - DNA, 32 bp, Homo sapiens
gctctgtcacccaggctggagtacagtggcat

SEQ ID NO: 11663 - DNA, 32 bp, Homo sapiens
actctgttgcccagtctggagttcagtggcgc

SEQ ID NO: 11664 - DNA, 31 bp, Homo sapiens
gtgagcagctgaagggctaggagggaagccg

SEQ ID NO: 11665 - DNA, 32 bp, Homo sapiens
cacgaggctggtccctggcccaacatgatact

SEQ ID NO: 11666 - DNA, 22 bp, Homo sapiens
ggcacaatctcagctcactgca

SEQ ID NO: 11667 - DNA, 32 bp, Homo sapiens
gagtcccaaccaccgaaacaccaccatcctgt

SEQ ID NO: 11668 - DNA, 32 bp, Homo sapiens
aaaatgcattatctccccagaccagagacagt

SEQ ID NO: 11669 - DNA, 32 bp, Homo sapiens
gatctgttacccaggctggagtgcagtgacac

SEQ ID NO: 11670 - DNA, 32 bp, Homo sapiens
agatgacaaagaggagtggaagaagacagaga

SEQ ID NO: 11671 - DNA, 32 bp, Homo sapiens
gcatgtagtaagccagaaaatattcaaagaga

SEQ ID NO: 11672 - DNA, 32 bp, Homo sapiens
ctccgtctcccaggccagagtgcagtggcgca

SEQ ID NO: 11673 - DNA, 32 bp, Homo sapiens
gtctttcacccaggctggagtgcagtgctgtg

SEQ ID NO: 11674 - DNA, 32 bp, Homo sapiens
tgctacccatcggcccttaataaatggcctca

SEQ ID NO: 11675 - DNA, 32 bp, Homo sapiens
gcccatctctaattataaaacatggttttgtt

SEQ ID NO: 11676 - DNA, 32 bp, Homo sapiens
actgccaatttctgaggctgaagccatttcac

SEQ ID NO: 11677 - DNA, 32 bp, Homo sapiens
acctaagtgcctcaggactgcaccttagggca

SEQ ID NO: 11678 - DNA, 32 bp, Homo sapiens
ggtctgaggcctgggagagtctctactgtcta

SEQ ID NO: 11679 - DNA, 32 bp, Homo sapiens
caccggtctgcatctcccagcagaaggcgcag

SEQ ID NO: 11680 - DNA, 18 bp, Homo sapiens
caggcactattgcctgga

SEQ ID NO: 11681 - DNA, 18 bp, Homo sapiens
gagaataagaattgcaga

SEQ ID NO: 11682 - DNA, 32 bp, Homo sapiens
actctgtctcccagactggagtgagtggtgtg

SEQ ID NO: 11683 - DNA, 32 bp, Homo sapiens
attgtagagcttggtggctgagcttggcccta

SEQ ID NO: 11684 - DNA, 32 bp, Homo sapiens
atccatcccagcacctggaacagggtctgaca

SEQ ID NO: 11685 - DNA, 32 bp, Homo sapiens
ttagaaaatgttccttttactgagatgcagtt

SEQ ID NO: 11686 - DNA, 32 bp, Homo sapiens
acctccacctcctgggtttaagcaatgcttct

SEQ ID NO: 11687 - DNA, 28 bp, Homo sapiens
catcccccaagtgcctcaccagtccccc

SEQ ID NO: 11688 - DNA, 32 bp, Homo sapiens
cccaggctggagtatagtagtgcagtggtgtg

SEQ ID NO: 11689 - DNA, 32 bp, Homo sapiens
agcctcctgagtagctgggattatggacaaat

SEQ ID NO: 11690 - DNA, 32 bp, Homo sapiens
acaagagggactgtatttctgtggaaaacaat

SEQ ID NO: 11691 - DNA, 32 bp, Homo sapiens
acctccatctcctgggtcccagcgattctcct

SEQ ID NO: 11692 - DNA, 24 bp, Homo sapiens
tcagaaggggccatctgggcccag

SEQ ID NO: 11693 - DNA, 24 bp, Homo sapiens
tcacgcctgtaatcctggcacttt

SEQ ID NO: 11694 - DNA, 32 bp, Homo sapiens
cgaggcctgagtattgcaatacatgcagtagt

SEQ ID NO: 11695 - DNA, 32 bp, Homo sapiens
gagcccaagaggtagaggttgcagtgagccaa

SEQ ID NO: 11696 - DNA, 32 bp, Homo sapiens
gcactcagtgttctgcctctggcagctgtgct

SEQ ID NO: 11697 - DNA, 32 bp, Homo sapiens
actttgttgcccaggctggagcgcagtggggt

SEQ ID NO: 11698 - DNA, 32 bp, Homo sapiens
atttctaaaatggcagcttcagttctagagaa

SEQ ID NO: 11699 - DNA, 21 bp, Homo sapiens
tcacacctgtaatcccagcac

SEQ ID NO: 11700 - DNA, 32 bp, Homo sapiens
aaatccaggaggcggaggttgcagtgagccaa

SEQ ID NO: 11701 - DNA, 32 bp, Homo sapiens
gctctgtcatccaggctggagtgcagtggcat

SEQ ID NO: 11702 - DNA, 32 bp, Homo sapiens
ccgtttccttgggaactggagtgcagtatgag

SEQ ID NO: 11703 - DNA, 32 bp, Homo sapiens
gggagagcctgaggctctgctcagggcccatt

SEQ ID NO: 11704 - DNA, 32 bp, Homo sapiens
tgaacctagtaacaggctttattttcaccttg

SEQ ID NO: 11705 - DNA, 32 bp, Homo sapiens
ttacacccaagtgtcctggttaacttgaagca

SEQ ID NO: 11706 - DNA, 32 bp, Homo sapiens
caagggcaagtgctagagttgcagtgaattta

SEQ ID NO: 11707 - DNA, 32 bp, Homo sapiens
cctctgttgccaggctagagtgcagtggcatg

SEQ ID NO: 11708 - DNA, 24 bp, Homo sapiens
tcatgcctgaaatcccaacacttt

SEQ ID NO: 11709 - DNA, 32 bp, Homo sapiens
ttacgactcctgtaatcccagcactttgggag

SEQ ID NO: 11710 - DNA, 28 bp, Homo sapiens
aggctcctgttgcctgcctcatcccaca

SEQ ID NO: 11711 - DNA, 32 bp, Homo sapiens
taactctgtgagtatgctcttctgcccaaaaa

SEQ ID NO: 11712 - DNA, 32 bp, Homo sapiens
ctccccacctgctaccccatctgcttgggccc

SEQ ID NO: 11713 - DNA, 24 bp, Homo sapiens
tcatgcctggaatcccagcacttt

SEQ ID NO: 11714 - DNA, 32 bp, Homo sapiens
catcacaggctagagaggtgagcttggaaaag

SEQ ID NO: 11715 - DNA, 32 bp, Homo sapiens
caggacttgggaagcagtcactgtgaaatgcg

SEQ ID NO: 11716 - DNA, 23 bp, Homo sapiens
tttactgggcggtttccatttga

SEQ ID NO: 11717 - DNA, 32 bp, Homo sapiens
tatttgatgcttcttcaagtcagctctgacgt

SEQ ID NO: 11718 - DNA, 32 bp, Homo sapiens
tttaagaaagagaatgaactgtggaatttatt

SEQ ID NO: 11719 - DNA, 32 bp, Homo sapiens
ctatgtcctagagatgggggaatgtgttattg

SEQ ID NO: 11720 - DNA, 32 bp, Homo sapiens
gaatctgggaggcagaggttgcagtgagccga

SEQ ID NO: 11721 - DNA, 32 bp, Homo sapiens
ctactcgggaggctgaggtaggaggatcgctt

SEQ ID NO: 11722 - DNA, 32 bp, Homo sapiens
ctctggttgcccaggctggagtgcagtggtgc

SEQ ID NO: 11723 - DNA, 32 bp, Homo sapiens
ctgtaactcgagagccagtagcattggattga

SEQ ID NO: 11724 - DNA, 32 bp, Homo sapiens
tcaaaatacctgtaatcccagcactttgggag

SEQ ID NO: 11725 - DNA, 32 bp, Homo sapiens
cccagggtaagtgcccacgaaagcccagtcca

SEQ ID NO: 11726 - DNA, 32 bp, Homo sapiens
cctccttctaccactggggtgctgctgtacca

SEQ ID NO: 11727 - DNA, 32 bp, Homo sapiens
cagtttggacaaggagcttcaaaactcggcca

SEQ ID NO: 11728 - DNA, 32 bp, Homo sapiens
agtctcctaaagtgctgggattacatgtgtga

SEQ ID NO: 11729 - DNA, 32 bp, Homo sapiens
tcagcctctcggtggtgggattatgaatgatt

SEQ ID NO: 11730 - DNA, 32 bp, Homo sapiens
acctgcgcctcctgggttcaagtgattcttct

SEQ ID NO: 11731 - DNA, 32 bp, Homo sapiens
gcataaaggagggcagaaagaaacagcagtgt

SEQ ID NO: 11732 - DNA, 32 bp, Homo sapiens
cgggaagctgaggtaggagaatctctcttttt

SEQ ID NO: 11733 - DNA, 32 bp, Homo sapiens
agtcagaggcctgggcgcagctctggactctg

SEQ ID NO: 11734 - DNA, 32 bp, Homo sapiens
agcacctctgcagcctgctgggcctcaggttc

SEQ ID NO: 11735 - DNA, 32 bp, Homo sapiens
atggcctctgcagattttcctgaacttctgct

SEQ ID NO: 11736 - DNA, 32 bp, Homo sapiens
ggactggagatctcctggatggagttggatta

SEQ ID NO: 11737 - DNA, 32 bp, Homo sapiens
aggacagggatttttgttcttgttgttctcgt

SEQ ID NO: 11738 - DNA, 32 bp, Homo sapiens
ggcccacagcactctgaacaggcacagccctc

SEQ ID NO: 11739 - DNA, 32 bp, Homo sapiens
aactgcttttcaagcatcatgctgctattcct

SEQ ID NO: 11740 - DNA, 32 bp, Homo sapiens
gaacctgggaggtggaggttgcagtgagcaga

SEQ ID NO: 11741 - DNA, 32 bp, Homo sapiens
gaacacaggaggcagaggttgcagtgagccga

SEQ ID NO: 11742 - DNA, 32 bp, Homo sapiens
tcttgttgcccaggcaggagtacaatggcagg

SEQ ID NO: 11743 - DNA, 32 bp, Homo sapiens
ttaaagccaccagggcttctggaacacctgtc

SEQ ID NO: 11744 - DNA, 32 bp, Homo sapiens
gaaccagggaggtggaggttgcagtgagctga

SEQ ID NO: 11745 - DNA, 32 bp, Homo sapiens
gctgtgttgcccaggctagagtgcagcagtga

SEQ ID NO: 11746 - DNA, 32 bp, Homo sapiens
tgtcagcatcttctcactcccttctccttgat

SEQ ID NO: 11747 - DNA, 32 bp, Homo sapiens
ggctcatacctgtaatgccagcactttgggag

SEQ ID NO: 11748 - DNA, 32 bp, Homo sapiens
aagttggattgagcatattcactgtgaaatta

SEQ ID NO: 11749 - DNA, 32 bp, Homo sapiens
gaagctgggaggcagagttttcagtgagccaa

SEQ ID NO: 11750 - DNA, 32 bp, Homo sapiens
acagggacactgtctgggggtgcagtgcaagc

SEQ ID NO: 11751 - DNA, 32 bp, Homo sapiens
actgcagcctccatcctctgggttcaagcaat

SEQ ID NO: 11752 - DNA, 32 bp, Homo sapiens
aaggcatctatctgtgctaggttaaatggttg

SEQ ID NO: 11753 - DNA, 32 bp, Homo sapiens
ctctgtcactcaggctggagtgcaatgacgtg

SEQ ID NO: 11754 - DNA, 32 bp, Homo sapiens
tggctcgggggatccaggttgcagatgaaata

SEQ ID NO: 11755 - DNA, 32 bp, Homo sapiens
tgagcccctaaccctgatccagggatcgttga

SEQ ID NO: 11756 - DNA, 19 bp, Homo sapiens
ctgagggatagagcctgag

SEQ ID NO: 11757 - DNA, 24 bp, Homo sapiens
gggcggaggagacccaggaagctg

SEQ ID NO: 11758 - DNA, 32 bp, Homo sapiens
ctcactgtcaccaggctggagtgcagtggtgc

SEQ ID NO: 11759 - DNA, 32 bp, Homo sapiens
ctcccagtgctgctgctgaccttcactgacag

SEQ ID NO: 11760 - DNA, 32 bp, Homo sapiens
gcagtaccattcaggacataggcacaggcaaa

SEQ ID NO: 11761 - DNA, 32 bp, Homo sapiens
ttctctcatgtggatggatggactctggggtt

SEQ ID NO: 11762 - DNA, 32 bp, Homo sapiens
atgagcctccaccacctcctctttgtgacatc

SEQ ID NO: 11763 - DNA, 32 bp, Homo sapiens
gaagctctcaagtgcggagaattctttgcaca

SEQ ID NO: 11764 - DNA, 32 bp, Homo sapiens
atcatgggtccaggctgatagcaatggacaga

SEQ ID NO: 11765 - DNA, 32 bp, Homo sapiens
gaaccagagaggtggaggttgcagtgaaccga

SEQ ID NO: 11766 - DNA, 32 bp, Homo sapiens
gtctatcctcaagttgctacggttcagtgaga

SEQ ID NO: 11767 - DNA, 32 bp, Homo sapiens
tgtggaagattctgagaaagaaaatagtttcc

SEQ ID NO: 11768 - DNA, 32 bp, Homo sapiens
gaaagcgggtgtctagaagtggtgctaatggg

SEQ ID NO: 11769 - DNA, 23 bp, Homo sapiens
tggcacaatcttgcctcactgca

SEQ ID NO: 11770 - DNA, 16 bp, Homo sapiens
ccagcgccacccagga

SEQ ID NO: 11771 - DNA, 25 bp, Homo sapiens
tccacatgaaacctacacactgtca

SEQ ID NO: 11772 - DNA, 32 bp, Homo sapiens
ggggtgggtgggcagaggacggggtaatgtga

SEQ ID NO: 11773 - DNA, 28 bp, Homo sapiens
cattccaagaatgaagcctcatcttgct

SEQ ID NO: 11774 - DNA, 32 bp, Homo sapiens
cggcagctctgtgcccttggccagcatgtgga

SEQ ID NO: 11775 - DNA, 32 bp, Homo sapiens
gaacgtgggaggcagaagttgcagtgagccaa

SEQ ID NO: 11776 - DNA, 32 bp, Homo sapiens
gtgatgccaccactgctcccaggagcccacag

SEQ ID NO: 11777 - DNA, 32 bp, Homo sapiens
gtctagaacttctggtctcaagcaatctgccc

SEQ ID NO: 11778 - DNA, 32 bp, Homo sapiens
acctcgacctcctgggttcaagcgattctccc

SEQ ID NO: 11779 - DNA, 32 bp, Homo sapiens
agaaagagaatgagagaaagagaatgagagag

SEQ ID NO: 11780 - DNA, 32 bp, Homo sapiens
ttgctagctcagtgaggggaattcttccagaa

SEQ ID NO: 11781 - DNA, 32 bp, Homo sapiens
agacaagggtggtggccgctctggaggtgcct

SEQ ID NO: 11782 - DNA, 32 bp, Homo sapiens
gctctgtcgcctaggctgcagtgcagtggcgg

SEQ ID NO: 11783 - DNA, 32 bp, Homo sapiens
ccccttcctcaagggtgtttgggttaaggctg

SEQ ID NO: 11784 - DNA, 32 bp, Homo sapiens
tgaaggtctgcagcttcgttcttaaagccagc

SEQ ID NO: 11785 - DNA, 32 bp, Homo sapiens
tctgccacatcctcaatctctaccggaggaac

SEQ ID NO: 11786 - DNA, 32 bp, Homo sapiens
tggctggggcacttatgctcccagagcctttg

SEQ ID NO: 11787 - DNA, 32 bp, Homo sapiens
ttgcactccagcccgggcaacaacagcgaaac

SEQ ID NO: 11788 - DNA, 32 bp, Homo sapiens
ctccctcggagacgcaggttgcagtggacatt

SEQ ID NO: 11789 - DNA, 32 bp, Homo sapiens
ctgagttctggacctacccccacgtggtgtaa

SEQ ID NO: 11790 - DNA, 32 bp, Homo sapiens
acatactctcacacaggaaacgacctggaaga

SEQ ID NO: 11791 - DNA, 32 bp, Homo sapiens
tgtgcggggccaggctgggagcccatgcagta

SEQ ID NO: 11792 - DNA, 24 bp, Homo sapiens
gtcctccaggctggagtgcaatga

SEQ ID NO: 11793 - DNA, 32 bp, Homo sapiens
cttcttagaagaggagtgagaggaaggcgggg

SEQ ID NO: 11794 - DNA, 32 bp, Homo sapiens
acagtggtgagctcttagcttcaccaggctca

SEQ ID NO: 11795 - DNA, 32 bp, Homo sapiens
ggagccccaagtcttggggaccacagaagatg

SEQ ID NO: 11796 - DNA, 21 bp, Homo sapiens
ctggccaacatggtgaaaccc

SEQ ID NO: 11797 - DNA, 21 bp, Homo sapiens
ctgaccaacatagtgaaaccc

SEQ ID NO: 11798 - DNA, 32 bp, Homo sapiens
ccctgttgcccaggctggagagcagtggtgca

SEQ ID NO: 11799 - DNA, 32 bp, Homo sapiens
ctctttcgcccaggccggactgcagtggcgca

SEQ ID NO: 11800 - DNA, 32 bp, Homo sapiens
gattccagtgagggagaaagtgatctgcaggg

SEQ ID NO: 11801 - DNA, 32 bp, Homo sapiens
agaacattccagaacccgttgtggaaaaaccc

SEQ ID NO: 11802 - DNA, 32 bp, Homo sapiens
ctgtgtcacccaggctggagtgcagtggtgca

SEQ ID NO: 11803 - DNA, 32 bp, Homo sapiens
ctgtgttgcccaggctggagtgcagtggtgtg

SEQ ID NO: 11804 - DNA, 32 bp, Homo sapiens
agaactggtgcagcttctctctccctccctcc

SEQ ID NO: 11805 - DNA, 32 bp, Homo sapiens
agatccagaagcagggaaagaaaacggcggat

SEQ ID NO: 11806 - DNA, 32 bp, Homo sapiens
cagccattgagtagctgggatgacaggcacat

SEQ ID NO: 11807 - DNA, 32 bp, Homo sapiens
ttctccccagttctgataccactaagaagaag

SEQ ID NO: 11808 - DNA, 19 bp, Homo sapiens
cagggatggcccccagccc

SEQ ID NO: 11809 - DNA, 32 bp, Homo sapiens
gctaaggcctgagagtttttgcagaaatgggg

SEQ ID NO: 11810 - DNA, 32 bp, Homo sapiens
aggaaaagacaatacccttcaaactttgagag

SEQ ID NO: 11811 - DNA, 32 bp, Homo sapiens
gcactgttgcccagtgtgggagttggtttaaa

SEQ ID NO: 11812 - DNA, 32 bp, Homo sapiens
ccccaggaaatgtgaagactggcagctttcaa

SEQ ID NO: 11813 - DNA, 32 bp, Homo sapiens
acactggcctccattctgacatctgggctggg

SEQ ID NO: 11814 - DNA, 32 bp, Homo sapiens
ttttgagaaacacaggcttctatgatttcagt

SEQ ID NO: 11815 - DNA, 32 bp, Homo sapiens
cccaggctggagtgcaatggtgcaatgatctc

SEQ ID NO: 11816 - DNA, 32 bp, Homo sapiens
gtccttctgagcggcttcctggggtcctcccc

SEQ ID NO: 11817 - DNA, 32 bp, Homo sapiens
ggctgtgggaggcagcggagcaggcgatgaag

SEQ ID NO: 11818 - DNA, 22 bp, Homo sapiens
ttgttaactaaaaacagtttgg

SEQ ID NO: 11819 - DNA, 32 bp, Homo sapiens
aaggtctctgcaggtttatctgcctggagcga

SEQ ID NO: 11820 - DNA, 24 bp, Homo sapiens
ctgttgcccaagttggagtgcaat

SEQ ID NO: 11821 - DNA, 32 bp, Homo sapiens
acagggttgcccagggtggagtgcagtggcag

SEQ ID NO: 11822 - DNA, 32 bp, Homo sapiens
atcctattagttctgtccctctagagaacccc

SEQ ID NO: 11823 - DNA, 32 bp, Homo sapiens
tgtttagaagtaggaagtcactgtgagcaatg

SEQ ID NO: 11824 - DNA, 32 bp, Homo sapiens
tgcccctgacactgcactgagcactttatgag

SEQ ID NO: 11825 - DNA, 32 bp, Homo sapiens
agcctcctgagtagctaggactgtaggcatgt

SEQ ID NO: 11826 - DNA, 32 bp, Homo sapiens
tgctcccacatcctgcttattgcctgccaccc

SEQ ID NO: 11827 - DNA, 21 bp, Homo sapiens
gcgcgatcatggctcactgca

SEQ ID NO: 11828 - DNA, 32 bp, Homo sapiens
gttttatctatctgtctttgcaagcagtcttc

SEQ ID NO: 11829 - DNA, 32 bp, Homo sapiens
ctgagctcaaaggatcctcccacctcagcctc

SEQ ID NO: 11830 - DNA, 32 bp, Homo sapiens
tctctgtggcccaggctgaagtgcagtggtgt

SEQ ID NO: 11831 - DNA, 32 bp, Homo sapiens
tttagatgacctctttccttgttttgttttca

SEQ ID NO: 11832 - DNA, 32 bp, Homo sapiens
ggaaaggcatcagcagggtgctttcaaccaca

SEQ ID NO: 11833 - DNA, 32 bp, Homo sapiens
agcccagggatgcaaaggttgcagtgagttga

SEQ ID NO: 11834 - DNA, 32 bp, Homo sapiens
tgtaagttcatctagatctccacctcacctgt

SEQ ID NO: 11835 - DNA, 32 bp, Homo sapiens
gccttgggacagctgggaacttaacttgaaat

SEQ ID NO: 11836 - DNA, 32 bp, Homo sapiens
tcgtccccaagtgtttcctgacacgcatcttt

SEQ ID NO: 11837 - DNA, 23 bp, Homo sapiens
tcacgcctgtaatcccagcactt

SEQ ID NO: 11838 - DNA, 32 bp, Homo sapiens
aggcagcaggaaggagaaaggagggaaggtaa

SEQ ID NO: 11839 - DNA, 32 bp, Homo sapiens
tagatcatggctgttcttcccacctcatccct

SEQ ID NO: 11840 - DNA, 32 bp, Homo sapiens
tgtaagaaacagtggcttatttcttcatttct

SEQ ID NO: 11841 - DNA, 23 bp, Homo sapiens
ctcaggagcctgaggcaggagaa

SEQ ID NO: 11842 - DNA, 32 bp, Homo sapiens
tggattcttaaccttgaatccaaagtgtctgc

SEQ ID NO: 11843 - DNA, 32 bp, Homo sapiens
gaatccaggaagcagaggttgcggtgagccga

SEQ ID NO: 11844 - DNA, 32 bp, Homo sapiens
ctgtagctattatgcttttaatattgttttaa

SEQ ID NO: 11845 - DNA, 32 bp, Homo sapiens
tcacctagactagactggagtgcaatggcctg

SEQ ID NO: 11846 - DNA, 32 bp, Homo sapiens
ctctgtcacccaggctggaatgcagtggcacg

SEQ ID NO: 11847 - DNA, 32 bp, Homo sapiens
gaaccggggagttggaggttgcagtgagccga

SEQ ID NO: 11848 - DNA, 32 bp, Homo sapiens
cctctttccccagcttctgtctgtctcactgt

SEQ ID NO: 11849 - DNA, 32 bp, Homo sapiens
ctcccgttgcatgtctggcttctgcctgtgct

SEQ ID NO: 11850 - DNA, 32 bp, Homo sapiens
gagtaggatgtctcttggaaatgttaagaaag

SEQ ID NO: 11851 - DNA, 32 bp, Homo sapiens
taacaaattaactaaggaaatatttcaatctc

SEQ ID NO: 11852 - DNA, 23 bp, Homo sapiens
cctctgcacctgcatgagaaccc

SEQ ID NO: 11853 - DNA, 18 bp, Homo sapiens
ctccgtaatgagagcccg

SEQ ID NO: 11854 - DNA, 32 bp, Homo sapiens
tcttgttgcccaagctggagtgcagtggtgca

SEQ ID NO: 11855 - DNA, 28 bp, Homo sapiens
cgactccaagacgctgcctcttcctgcg

SEQ ID NO: 11856 - DNA, 32 bp, Homo sapiens
tgggtttgtgtgtgtggatgtggtttctgcct

SEQ ID NO: 11857 - DNA, 32 bp, Homo sapiens
atcaaactgagatttcaagtcgtactatggaa

SEQ ID NO: 11858 - DNA, 32 bp, Homo sapiens
caccgatttatggtgctgacatcagtggctcc

SEQ ID NO: 11859 - DNA, 32 bp, Homo sapiens
gccaccaggcctggctccttttccactttcat

SEQ ID NO: 11860 - DNA, 32 bp, Homo sapiens
gcgcctgctccacgttctcttctgtctgttgc

SEQ ID NO: 11861 - DNA, 21 bp, Homo sapiens
gcccctctcccctgcccaagt

SEQ ID NO: 11862 - DNA, 32 bp, Homo sapiens
catccaagaagaggagaaaacactgacaaaga

SEQ ID NO: 11863 - DNA, 32 bp, Homo sapiens
tcttgttgcccaggcggagtgcagtggaacaa

SEQ ID NO: 11864 - DNA, 32 bp, Homo sapiens
cttcccgggaggcagccccgggatgctgagag

SEQ ID NO: 11865 - DNA, 32 bp, Homo sapiens
tcagtgggggcagtcaggccaaacttctcatt

SEQ ID NO: 11866 - DNA, 32 bp, Homo sapiens
tgctatggtctcccctaggaatgtgatagata

SEQ ID NO: 11867 - DNA, 32 bp, Homo sapiens
agcttcctgagtagctgggattacaggagcat

SEQ ID NO: 11868 - DNA, 32 bp, Homo sapiens
ttcttgaaagacagctggctgtggagagcctt

SEQ ID NO: 11869 - DNA, 32 bp, Homo sapiens
ctgcaagctctgcctctcaggttcaagtgatt

SEQ ID NO: 11870 - DNA, 32 bp, Homo sapiens
tgttcccttaggtttttccccacctcaattta

SEQ ID NO: 11871 - DNA, 32 bp, Homo sapiens
gggttcacaagcaattctcatgcctcagcctc

SEQ ID NO: 11872 - DNA, 32 bp, Homo sapiens
actgtagccttttaagcttcagtctcagcaga

SEQ ID NO: 11873 - DNA, 32 bp, Homo sapiens
tcaccctctgcaggcccagctcctgcctccaa

SEQ ID NO: 11874 - DNA, 32 bp, Homo sapiens
cttgttcactggaccagtagtcactgttaaat

SEQ ID NO: 11875 - DNA, 32 bp, Homo sapiens
ccgtcattgctgctgctaccagcgccaaatgt

SEQ ID NO: 11876 - DNA, 21 bp, Homo sapiens
gccaccaacagccactcagaa

SEQ ID NO: 11877 - DNA, 32 bp, Homo sapiens
cctcgtcaccctgacatctctccgggaagact

SEQ ID NO: 11878 - DNA, 32 bp, Homo sapiens
agagagggccaggcagtcgcactgtgaacaga

SEQ ID NO: 11879 - DNA, 32 bp, Homo sapiens
tttctgccacccaggctggagtacagtggcat

SEQ ID NO: 11880 - DNA, 32 bp, Homo sapiens
gtgagtagcctatgaatgaaattcttttataa

SEQ ID NO: 11881 - DNA, 32 bp, Homo sapiens
gcctcaaccttctgggttcaagcgatcctccc

SEQ ID NO: 11882 - DNA, 32 bp, Homo sapiens
ttcacacggaggcagaggtggggatgaggtat

SEQ ID NO: 11883 - DNA, 32 bp, Homo sapiens
cgaacaggaagaggacggaaaagataaccgtc

SEQ ID NO: 11884 - DNA, 32 bp, Homo sapiens
ggagaagaaccatttacatgcaccttatattt

SEQ ID NO: 11885 - DNA, 32 bp, Homo sapiens
gcctcatgcctgtaattccagcactttgggag

SEQ ID NO: 11886 - DNA, 32 bp, Homo sapiens
ccggggcgtcttctcctacgcaggaagggcca

SEQ ID NO: 11887 - DNA, 32 bp, Homo sapiens
gaaggaacaagaggagaaagcagagataaaac

SEQ ID NO: 11888 - DNA, 32 bp, Homo sapiens
cataaaagaagaggcgagtagggcacaacagg

SEQ ID NO: 11889 - DNA, 32 bp, Homo sapiens
ttgagatggagttttgctcttgtagcccaggc

SEQ ID NO: 11890 - DNA, 32 bp, Homo sapiens
ttgagactgagtttcactcttgttgcccaggc

SEQ ID NO: 11891 - DNA, 32 bp, Homo sapiens
tttatggctgctgggctgagtgacacaagcac

SEQ ID NO: 11892 - DNA, 32 bp, Homo sapiens
ggaaaagagaaaagggaaagaaatccagagaa

SEQ ID NO: 11893 - DNA, 32 bp, Homo sapiens
cactggccagttctaccatagacttgactgca

SEQ ID NO: 11894 - DNA, 32 bp, Homo sapiens
gaggcagcagaactaagtctgaaccgccaaga

SEQ ID NO: 11895 - DNA, 32 bp, Homo sapiens
gacggtgaccatgggggatgtgaagctggttg

SEQ ID NO: 11896 - DNA, 32 bp, Homo sapiens
cctctttgctgacctggaggtgatctgtgtat

SEQ ID NO: 11897 - DNA, 32 bp, Homo sapiens
gaacccaggaggcaaaggttgcagtgagccac

SEQ ID NO: 11898 - DNA, 32 bp, Homo sapiens
ctactcgggaggctgaggcaggagaatcacat

SEQ ID NO: 11899 - DNA, 32 bp, Homo sapiens
catgtctgcccagggggactgcgagttcctgg

SEQ ID NO: 11900 - DNA, 28 bp, Homo sapiens
cagctgccaagtgctctttgttactgtc

SEQ ID NO: 11901 - DNA, 28 bp, Homo sapiens
cttgtcccaagtgggctacatttgaaga

SEQ ID NO: 11902 - DNA, 32 bp, Homo sapiens
tcctacccaagtggcctccagctgtccgttag

SEQ ID NO: 11903 - DNA, 32 bp, Homo sapiens
gccgagacttgttggccgcggagactgcgacc

SEQ ID NO: 11904 - DNA, 32 bp, Homo sapiens
ttttgtcaccgaggctggagtgcaatggcccg

SEQ ID NO: 11905 - DNA, 32 bp, Homo sapiens
aaccatcaacatctctggtgttttaagatgtt

SEQ ID NO: 11906 - DNA, 32 bp, Homo sapiens
cctcttctggtctttcctcttctgtttatgga

SEQ ID NO: 11907 - DNA, 32 bp, Homo sapiens
ccaagatctttttgccccatctcctagagaaa

SEQ ID NO: 11908 - DNA, 32 bp, Homo sapiens
gccaatacgttctaccgagagcactttggaat

SEQ ID NO: 11909 - DNA, 32 bp, Homo sapiens
ttgcctgttgccagactggagtgcagtggcac

SEQ ID NO: 11910 - DNA, 32 bp, Homo sapiens
atgaccagagttctgtgcataacaggatccca

SEQ ID NO: 11911 - DNA, 32 bp, Homo sapiens
ctcagctccagcataccccaccaccttctcct

SEQ ID NO: 11912 - DNA, 32 bp, Homo sapiens
ttttccctacctctgtcattagcaatggttga

SEQ ID NO: 11913 - DNA, 32 bp, Homo sapiens
actccgcagctttcggcctcggtgagcgggtg

SEQ ID NO: 11914 - DNA, 32 bp, Homo sapiens
ttaaggtgatttttacagaaatgtgattttgc

SEQ ID NO: 11915 - DNA, 32 bp, Homo sapiens
ggaaaggggcctgggctcttcatttaaaggta

SEQ ID NO: 11916 - DNA, 32 bp, Homo sapiens
tgtgtggagttttccatgaagtgcagtcccaa

SEQ ID NO: 11917 - DNA, 32 bp, Homo sapiens
gctctgctgcccaggctagagtgcagtggcgt

SEQ ID NO: 11918 - DNA, 22 bp, Homo sapiens
gggaggcagccttcaccaggga

SEQ ID NO: 11919 - DNA, 32 bp, Homo sapiens
ctctgtcgcccaggctggaatgcagtggcgtg

SEQ ID NO: 11920 - DNA, 32 bp, Homo sapiens
ctactcgggaggctgaggcaggagaatggtgc

SEQ ID NO: 11921 - DNA, 32 bp, Homo sapiens
gaacctgggaggtggagattgcagtgagccca

SEQ ID NO: 11922 - DNA, 32 bp, Homo sapiens
aaggccaggcctggagcttgcctcttcagtat

SEQ ID NO: 11923 - DNA, 32 bp, Homo sapiens
cttggttcaacaacaagaacttacttaaaaca

SEQ ID NO: 11924 - DNA, 32 bp, Homo sapiens
ctctgttacccaggctggaatgcagtggcgca

SEQ ID NO: 11925 - DNA, 32 bp, Homo sapiens
gcctgcccaaccagactggtagtcctgcagtc

SEQ ID NO: 11926 - DNA, 32 bp, Homo sapiens
accaccctcaccaattctctcaatccccatga

SEQ ID NO: 11927 - DNA, 32 bp, Homo sapiens
ggctcactcctgtaatcccagcactttggagg

SEQ ID NO: 11928 - DNA, 32 bp, Homo sapiens
tttagacatcttctacttgctcttggccttga

SEQ ID NO: 11929 - DNA, 32 bp, Homo sapiens
gtcaccatcctcatccccatcttcatggaacc

SEQ ID NO: 11930 - DNA, 22 bp, Homo sapiens
tcatgtctgtaatcccagcact

SEQ ID NO: 11931 - DNA, 32 bp, Homo sapiens
tctcttagagcctctagaaagaactagcccta

SEQ ID NO: 11932 - DNA, 32 bp, Homo sapiens
ggtcttgtcttcccagccgcagtctaggaatg

SEQ ID NO: 11933 - DNA, 32 bp, Homo sapiens
gggatgctgcctctgctgcttctgccttcttt

SEQ ID NO: 11934 - DNA, 32 bp, Homo sapiens
cacgctgtcaccaggctggagtgcagtggcgc

SEQ ID NO: 11935 - DNA, 32 bp, Homo sapiens
gctctgtcacccaggctggagtgcaatgggca

SEQ ID NO: 11936 - DNA, 24 bp, Homo sapiens
aacaaactgttcggctactggaca

SEQ ID NO: 11937 - DNA, 32 bp, Homo sapiens
ctcacggggcggcagaggcaacttcagtgtcc

SEQ ID NO: 11938 - DNA, 32 bp, Homo sapiens
tttgttacaatcctgaatctttgctttttgca

SEQ ID NO: 11939 - DNA, 32 bp, Homo sapiens
ctgtgtcatgcaggctggagtgaagtcgtgtg

SEQ ID NO: 11940 - DNA, 32 bp, Homo sapiens
ctgacctcaggtgatacgcccacctcggcctc

SEQ ID NO: 11941 - DNA, 32 bp, Homo sapiens
agccgcctgagtagctgggaccacagtttcag

SEQ ID NO: 11942 - DNA, 32 bp, Homo sapiens
aacaccagggggcagaggtcaggagaatcatc

SEQ ID NO: 11943 - DNA, 19 bp, Homo sapiens
ggcccttggcccgctgcag

SEQ ID NO: 11944 - DNA, 32 bp, Homo sapiens
gctttgtcctgagacatccggaaaggaaaggg

SEQ ID NO: 11945 - DNA, 32 bp, Homo sapiens
tttccttatcttctcccccatggcatcctaaa

SEQ ID NO: 11946 - DNA, 32 bp, Homo sapiens
caggaggtcaggtcaaggctgcagtgagccat

SEQ ID NO: 11947 - DNA, 28 bp, Homo sapiens
agctcccgtgcatctgcctcatctctcc

SEQ ID NO: 11948 - DNA, 28 bp, Homo sapiens
ttcccagaagctgctgcctcttcctgag

SEQ ID NO: 11949 - DNA, 32 bp, Homo sapiens
catttcccaagtgctattgcaataacagttga

SEQ ID NO: 11950 - DNA, 32 bp, Homo sapiens
ctcttcaggttctcatgataccacctttactg

SEQ ID NO: 11951 - DNA, 32 bp, Homo sapiens
acaacaacaacaacaaaaaccctattccttgc

SEQ ID NO: 11952 - DNA, 32 bp, Homo sapiens
gccccacacacaacagggtaaattcctactcc

SEQ ID NO: 11953 - DNA, 32 bp, Homo sapiens
tatttctctctcccataacagtgcagtgatag

SEQ ID NO: 11954 - DNA, 21 bp, Homo sapiens
ctggtcaacatggtgaaaccc

SEQ ID NO: 11955 - DNA, 32 bp, Homo sapiens
tgtttccctcaaggacctttctgcctggaagt

SEQ ID NO: 11956 - DNA, 32 bp, Homo sapiens
actgcagcctccacctcctgggctcaagcgat

SEQ ID NO: 11957 - DNA, 32 bp, Homo sapiens
ccagcggggatagaggcttcaaaagctttgaa

SEQ ID NO: 11958 - DNA, 32 bp, Homo sapiens
ctctgtcgcccaggctggagtgcagtgtcaag

SEQ ID NO: 11959 - DNA, 32 bp, Homo sapiens
tcttccgcctcccgggttcaagcgattctcct

SEQ ID NO: 11960 - DNA, 32 bp, Homo sapiens
acctgacccagtgccctgcgacacgcccacag

SEQ ID NO: 11961 - DNA, 32 bp, Homo sapiens
tagtgtctccttcctaaagagcacttttgtat

SEQ ID NO: 11962 - DNA, 32 bp, Homo sapiens
ggctcatgcctgtgatcgcagcactttgggag

SEQ ID NO: 11963 - DNA, 32 bp, Homo sapiens
cgttcaagtctacgagcacagccgtgttctaa

SEQ ID NO: 11964 - DNA, 32 bp, Homo sapiens
ctcctccctcttctcctctgtggcctgggaga

SEQ ID NO: 11965 - DNA, 20 bp, Homo sapiens
gcccctgcctgatgcatgta

SEQ ID NO: 11966 - DNA, 24 bp, Homo sapiens
tcacgcctgtaatcgcggcacttt

SEQ ID NO: 11967 - DNA, 16 bp, Homo sapiens
agatgcagccttgcag

SEQ ID NO: 11968 - DNA, 32 bp, Homo sapiens
cccctctctgcagcctctcctgccactcgggg

SEQ ID NO: 11969 - DNA, 32 bp, Homo sapiens
ttgtgtcatcttcttaccatgatcaaaggcga

SEQ ID NO: 11970 - DNA, 32 bp, Homo sapiens
gattcagggccagcaggtttcactcagctctc

SEQ ID NO: 11971 - DNA, 32 bp, Homo sapiens
cactccttgctgctgccggcggttccagcctg

SEQ ID NO: 11972 - DNA, 23 bp, Homo sapiens
aacaacctgacaaactgtggcca

SEQ ID NO: 11973 - DNA, 32 bp, Homo sapiens
ggcccagcctccatcttcgtctctcaggacgg

SEQ ID NO: 11974 - DNA, 32 bp, Homo sapiens
tggcctcctagagtgctgggattacaggtgtg

SEQ ID NO: 11975 - DNA, 32 bp, Homo sapiens
taaaccctcactgactttttagcaataaagct

SEQ ID NO: 11976 - DNA, 32 bp, Homo sapiens
tgccaagtttgacggtgaagtgatctgtgaac

SEQ ID NO: 11977 - DNA, 32 bp, Homo sapiens
agcctgtggtctccatggcaatgggtgtccat

SEQ ID NO: 11978 - DNA, 32 bp, Homo sapiens
caaggtgtctagtccagctcccatggagggtg

SEQ ID NO: 11979 - DNA, 32 bp, Homo sapiens
ccaccctcttgtgcccttaagcattactttaa

SEQ ID NO: 11980 - DNA, 24 bp, Homo sapiens
tcacacctgtactcccagcatttt

SEQ ID NO: 11981 - DNA, 32 bp, Homo sapiens
aactgagagcaatttcaaaaggctgctgatgt

SEQ ID NO: 11982 - DNA, 32 bp, Homo sapiens
ccaggttcaagcaattctccttcctcagcctc

SEQ ID NO: 11983 - DNA, 32 bp, Homo sapiens
cgatttgtgctgctctcagcagccaccgggga

SEQ ID NO: 11984 - DNA, 32 bp, Homo sapiens
gattttcctctacgtgcttcagtcttctctac

SEQ ID NO: 11985 - DNA, 32 bp, Homo sapiens
ggaaaaagatcattcgggaaatggcggtggct

SEQ ID NO: 11986 - DNA, 32 bp, Homo sapiens
ctttgtgccctagactggagtgcaatggcgcc

SEQ ID NO: 11987 - DNA, 32 bp, Homo sapiens
gagcctgggaggcagaggctgcagtgagccga

SEQ ID NO: 11988 - DNA, 32 bp, Homo sapiens
tgccgacttcttctccccagagcctggctttt

SEQ ID NO: 11989 - DNA, 31 bp, Homo sapiens
acaacacacatctgggacaggagggaatccg

SEQ ID NO: 11990 - DNA, 24 bp, Homo sapiens
tcatgcctatattccctgcacttt

SEQ ID NO: 11991 - DNA, 23 bp, Homo sapiens
gtcacccaggctggaatgcagtg

SEQ ID NO: 11992 - DNA, 23 bp, Homo sapiens
gtcacccgggctggagtgcagtg

SEQ ID NO: 11993 - DNA, 32 bp, Homo sapiens
ccagcttcttctcctggatccagtagagtttc

SEQ ID NO: 11994 - DNA, 20 bp, Homo sapiens
tctgtcttgggagtggtgta

SEQ ID NO: 11995 - DNA, 32 bp, Homo sapiens
gcctccctgagtctcgctcttttgcccaggct

SEQ ID NO: 11996 - DNA, 32 bp, Homo sapiens
tggattgtgctgctctcgtttcagctttgatt

SEQ ID NO: 11997 - DNA, 32 bp, Homo sapiens
ctactttcattcaggctggagtgcagtggcat

SEQ ID NO: 11998 - DNA, 32 bp, Homo sapiens
ggcctgggttttgttgcataccacagattgtc

SEQ ID NO: 11999 - DNA, 32 bp, Homo sapiens
tcattgtaagttctgtcctacagagaagtgtg

SEQ ID NO: 12000 - DNA, 32 bp, Homo sapiens
tactactttgaccttccgagtgcagtgaggca

SEQ ID NO: 12001 - DNA, 32 bp, Homo sapiens
ttttaaaaagagactgtatacacttgatttgc

SEQ ID NO: 12002 - DNA, 32 bp, Homo sapiens
ttgagttctgctggacaggagcactttatctg

SEQ ID NO: 12003 - DNA, 32 bp, Homo sapiens
ggactctgcccaggccagcgtgttctgaaaat

SEQ ID NO: 12004 - DNA, 32 bp, Homo sapiens
acctggcaacatcacgatttaagctaaggttg

SEQ ID NO: 12005 - DNA, 32 bp, Homo sapiens
actctgtagcccagtctggagtgcagtggtgt

SEQ ID NO: 12006 - DNA, 32 bp, Homo sapiens
tgcagaatgagaggagagagggaaggcaggtc

SEQ ID NO: 12007 - DNA, 32 bp, Homo sapiens
ccagcatctgcagccactttctgccagcatct

SEQ ID NO: 12008 - DNA, 32 bp, Homo sapiens
aggagttgtttctgacccactgatctctacta

SEQ ID NO: 12009 - DNA, 32 bp, Homo sapiens
gcctcaacctcccaggttcaagcgattctcct

SEQ ID NO: 12010 - DNA, 32 bp, Homo sapiens
acgtctgcctcctgggttcaagcaattctcct

SEQ ID NO: 12011 - DNA, 32 bp, Homo sapiens
tgaacccagaagcggaggttgcagtgagctga

SEQ ID NO: 12012 - DNA, 31 bp, Homo sapiens
gaagagacatcacccagtaggagggagtacg

SEQ ID NO: 12013 - DNA, 32 bp, Homo sapiens
ggctcatgcctgtaacctcagcactttgggag

SEQ ID NO: 12014 - DNA, 32 bp, Homo sapiens
tgtggttcatcaggtgaggaattctttaataa

SEQ ID NO: 12015 - DNA, 32 bp, Homo sapiens
atttttcttaaccttggagatggctgtctagg

SEQ ID NO: 12016 - DNA, 32 bp, Homo sapiens
cgcgaggatgccttttctcttctgccttgcga

SEQ ID NO: 12017 - DNA, 32 bp, Homo sapiens
taatagtgtcttctccccgggtttggtggcct

SEQ ID NO: 12018 - DNA, 32 bp, Homo sapiens
gacatgcgggagagagaatgagccagagggac

SEQ ID NO: 12019 - DNA, 16 bp, Homo sapiens
ctattaccacccagaa

SEQ ID NO: 12020 - DNA, 32 bp, Homo sapiens
tttattcttatttttggagacagggtctcgct

SEQ ID NO: 12021 - DNA, 32 bp, Homo sapiens
gcattgcacatccgtgcagaaatctttctgac

SEQ ID NO: 12022 - DNA, 32 bp, Homo sapiens
taaatctggctgtattcagtagcaatacaaaa

SEQ ID NO: 12023 - DNA, 32 bp, Homo sapiens
tgcgtgcctgtgtgctgggatctagcgtggcc

SEQ ID NO: 12024 - DNA, 28 bp, Homo sapiens
gtttctctccactctgcctcatctctgt

SEQ ID NO: 12025 - DNA, 32 bp, Homo sapiens
gtacccaggaggtggaggttgcggtgaactga

SEQ ID NO: 12026 - DNA, 32 bp, Homo sapiens
ggaaaagaaaaaggagaaaaacaaagagattt

SEQ ID NO: 12027 - DNA, 32 bp, Homo sapiens
tcagagagtctacagaacacgcacgacgacag

SEQ ID NO: 12028 - DNA, 32 bp, Homo sapiens
agcctaccaagtagctgggattacaggagtgc

SEQ ID NO: 12029 - DNA, 32 bp, Homo sapiens
gctttgcatcttctccaggccctggacttcct

SEQ ID NO: 12030 - DNA, 24 bp, Homo sapiens
tcacgcctgtaatcctaacacttt

SEQ ID NO: 12031 - DNA, 23 bp, Homo sapiens
gcaagagttctgtggagagagtg

SEQ ID NO: 12032 - DNA, 32 bp, Homo sapiens
tccatttctgcagcttagcttgtgtcctgccc

SEQ ID NO: 12033 - DNA, 32 bp, Homo sapiens
gccacctctgcaggggtttcctcttcagcctg

SEQ ID NO: 12034 - DNA, 32 bp, Homo sapiens
gaaggacatcttcaccgtctccatgaatgaga

SEQ ID NO: 12035 - DNA, 32 bp, Homo sapiens
caagctcttacagagttgacagtctagtttca

SEQ ID NO: 12036 - DNA, 27 bp, Homo sapiens
acaaaaattgatataatacattcatca

SEQ ID NO: 12037 - DNA, 32 bp, Homo sapiens
gggtgttgtctgcagaaccaccaccttgaaag

SEQ ID NO: 12038 - DNA, 32 bp, Homo sapiens
actctattgcccaggctggagtgcactggcgt

SEQ ID NO: 12039 - DNA, 32 bp, Homo sapiens
gctctgtcgcccaggctggagttcagtggcgc

SEQ ID NO: 12040 - DNA, 32 bp, Homo sapiens
gctcaccacaaccttgaactcccaggctcaag

SEQ ID NO: 12041 - DNA, 32 bp, Homo sapiens
catgataccaggcccaggagatcagtaattac

SEQ ID NO: 12042 - DNA, 23 bp, Homo sapiens
ggccacagctttggcgggcactt

SEQ ID NO: 12043 - DNA, 32 bp, Homo sapiens
ccctaatctgcagccccgcctttgcctactcc

SEQ ID NO: 12044 - DNA, 32 bp, Homo sapiens
gggaggagaatgtcctggaagggcaggactct

SEQ ID NO: 12045 - DNA, 32 bp, Homo sapiens
gctctgtcgcccaggctggagtgcagtggagc

SEQ ID NO: 12046 - DNA, 32 bp, Homo sapiens
gagagaagaggaggagaagggagggggtggcc

SEQ ID NO: 12047 - DNA, 32 bp, Homo sapiens
taaagaccagttctttaagctaagacatgtaa

SEQ ID NO: 12048 - DNA, 32 bp, Homo sapiens
ctctgtcgcccagggctggagtgcagtggcgc

SEQ ID NO: 12049 - DNA, 32 bp, Homo sapiens
ccatccttgcccagccggtgtggtgcttgtgt

SEQ ID NO: 12050 - DNA, 32 bp, Homo sapiens
ccctctgtcaccaggctggagtgcagtggtgc

SEQ ID NO: 12051 - DNA, 32 bp, Homo sapiens
ccgaaagcctagagaccgccactgtgattcac

SEQ ID NO: 12052 - DNA, 32 bp, Homo sapiens
cactgtcgcctaggctggagtgcaacagtgtg

SEQ ID NO: 12053 - DNA, 32 bp, Homo sapiens
aagatccccaggggactgggtgcagtggctca

SEQ ID NO: 12054 - DNA, 32 bp, Homo sapiens
caggtgagaaaacaggctaataacttccatga

SEQ ID NO: 12055 - DNA, 32 bp, Homo sapiens
gggccagggaggttgaggctgcagtgagctat

SEQ ID NO: 12056 - DNA, 32 bp, Homo sapiens
agaattcagagccaatatgtgcttgcttatta

SEQ ID NO: 12057 - DNA, 32 bp, Homo sapiens
ctctgtcccccaggctgaagtgcagcggcatg

SEQ ID NO: 12058 - DNA, 32 bp, Homo sapiens
gaactcgggaggcggatgttgcagtgagccaa

SEQ ID NO: 12059 - DNA, 32 bp, Homo sapiens
gagcctgggaggtcaaggctgcagtgagccgt

SEQ ID NO: 12060 - DNA, 32 bp, Homo sapiens
gaacctgggaggcggagcttgcagtgagccca

SEQ ID NO: 12061 - DNA, 32 bp, Homo sapiens
gagcccaggaggtcgaggctgcagtgagctgt

SEQ ID NO: 12062 - DNA, 32 bp, Homo sapiens
gagcctaggaggtcaaggctgcagtgagccat

SEQ ID NO: 12063 - DNA, 32 bp, Homo sapiens
gaagacgatgggcagaggagtgacagccgcag

SEQ ID NO: 12064 - DNA, 32 bp, Homo sapiens
ctctgttgcccaggctggagtgtagtggtgcg

SEQ ID NO: 12065 - DNA, 32 bp, Homo sapiens
ctctgtcgcccaggctggagtgcagtggtgcg

SEQ ID NO: 12066 - DNA, 32 bp, Homo sapiens
ttctacccaagtgcttttgcttacagcagata

SEQ ID NO: 12067 - DNA, 32 bp, Homo sapiens
cagaaaagaagaggcagaaatccaagcagaac

SEQ ID NO: 12068 - DNA, 32 bp, Homo sapiens
ctctgttgcccaggctggagtgcagtggtgtg

SEQ ID NO: 12069 - DNA, 32 bp, Homo sapiens
ctctgtcacccaggctggagtgtagtggtgta

SEQ ID NO: 12070 - DNA, 32 bp, Homo sapiens
ggacgtcggcttctccccgcgggagcccccag

SEQ ID NO: 12071 - DNA, 32 bp, Homo sapiens
cctgggcatcttctactaatggcctcggcttc

SEQ ID NO: 12072 - DNA, 32 bp, Homo sapiens
ggagtctaaagaagagaaagaaaatcaagatg

SEQ ID NO: 12073 - DNA, 17 bp, Homo sapiens
gctttgtccacccagaa

SEQ ID NO: 12074 - DNA, 32 bp, Homo sapiens
atttttccacaccttgaagtcacagtgtttta

SEQ ID NO: 12075 - DNA, 32 bp, Homo sapiens
ctctgtcacccaggctggagtgcagtggtgca

SEQ ID NO: 12076 - DNA, 23 bp, Homo sapiens
tggcgccatctcggctcactgca

SEQ ID NO: 12077 - DNA, 23 bp, Homo sapiens
tggcaccatctcagctcactgca

SEQ ID NO: 12078 - DNA, 32 bp, Homo sapiens
atgtcttattttatttgtcaggcacagatgct

SEQ ID NO: 12079 - DNA, 32 bp, Homo sapiens
gctctgttgcccacgcaggagtgcagtggcat

SEQ ID NO: 12080 - DNA, 32 bp, Homo sapiens
tcttgctcgcccagggtggagtgcagtggtgt

SEQ ID NO: 12081 - DNA, 23 bp, Homo sapiens
tggcacgatctcaggtcactgca

SEQ ID NO: 12082 - DNA, 32 bp, Homo sapiens
acactggaaggagcgctctcactgtggaagag

SEQ ID NO: 12083 - DNA, 32 bp, Homo sapiens
catttcgggaggctgaggcaggaggatcattt

SEQ ID NO: 12084 - DNA, 32 bp, Homo sapiens
gcgcgtggttggcagaggcagagacataagac

SEQ ID NO: 12085 - DNA, 32 bp, Homo sapiens
attacgtgaacgcatcctctttgctaggtcaa

SEQ ID NO: 12086 - DNA, 32 bp, Homo sapiens
tttggaaggtgacactgctccctgaattaagg

SEQ ID NO: 12087 - DNA, 32 bp, Homo sapiens
ctgctgtgagccacctgcctgtggagtgctga

SEQ ID NO: 12088 - DNA, 32 bp, Homo sapiens
acctctgtctcccgggttcaagcaattctcct

SEQ ID NO: 12089 - DNA, 32 bp, Homo sapiens
gcagaagctgcagagaattttctgcctgacga

SEQ ID NO: 12090 - DNA, 32 bp, Homo sapiens
tcagtttacctgcacatgctttctttcatttc

SEQ ID NO: 12091 - DNA, 32 bp, Homo sapiens
ttctgttgcctaggctggagtgcagtggcgca

SEQ ID NO: 12092 - DNA, 32 bp, Homo sapiens
tcactgttgcccaggctggagtgcagtggtgc

SEQ ID NO: 12093 - DNA, 18 bp, Homo sapiens
aaggggcccagaaatctg

SEQ ID NO: 12094 - DNA, 32 bp, Homo sapiens
gccgagagccacactttcaagtaaccaggtgg

SEQ ID NO: 12095 - DNA, 32 bp, Homo sapiens
atgtgtggtgttcttctggaggttgtctcttt

SEQ ID NO: 12096 - DNA, 28 bp, Homo sapiens
tcagctccctgtgctgcctgatttctca

SEQ ID NO: 12097 - DNA, 32 bp, Homo sapiens
caaggtcatagagtgagtgcctgagtcatcca

SEQ ID NO: 12098 - DNA, 32 bp, Homo sapiens
ccactcgggaggctgaggcaggagaatgatgt

SEQ ID NO: 12099 - DNA, 32 bp, Homo sapiens
agcctcctgagtagctgggatcatagatgcct

SEQ ID NO: 12100 - DNA, 32 bp, Homo sapiens
tctggttgcccaggctggagtgcagtggtgcc

SEQ ID NO: 12101 - DNA, 32 bp, Homo sapiens
acctctgccacctgggttcaagcgattctcct

SEQ ID NO: 12102 - DNA, 32 bp, Homo sapiens
gcatggagctctggcatccccacctcagtatc

SEQ ID NO: 12103 - DNA, 32 bp, Homo sapiens
ttgggttcaagcaattcttctgcctcagcctc

SEQ ID NO: 12104 - DNA, 32 bp, Homo sapiens
ggctcatgcctgcaattccagcactttgggag

SEQ ID NO: 12105 - DNA, 32 bp, Homo sapiens
tagattgtttcagcttctcttgtttcattttc

SEQ ID NO: 12106 - DNA, 32 bp, Homo sapiens
acactgcatatggtccccatctggcctcagag

SEQ ID NO: 12107 - DNA, 32 bp, Homo sapiens
tttgggggttggtcagcaactttgagtgccat

SEQ ID NO: 12108 - DNA, 32 bp, Homo sapiens
ctgcagcctgagccttcttactgtgaattata

SEQ ID NO: 12109 - DNA, 32 bp, Homo sapiens
gtaagagtggtctcttcttattgaacaacctc

SEQ ID NO: 12110 - DNA, 32 bp, Homo sapiens
cccacagcagctttgctcagtgatacccacat

SEQ ID NO: 12111 - DNA, 32 bp, Homo sapiens
tgttattccagtgccctgtaacaatcactggt

SEQ ID NO: 12112 - DNA, 32 bp, Homo sapiens
gtggcagccccgggtgggtgtgatctgtggct

SEQ ID NO: 12113 - DNA, 32 bp, Homo sapiens
actttgtcacccaggctggagtgcaatggcgt

SEQ ID NO: 12114 - DNA, 32 bp, Homo sapiens
gagaacgggcccagggtgctgtggagatcaac

SEQ ID NO: 12115 - DNA, 32 bp, Homo sapiens
atgaaatcaaatggtttcctggattactgcat

SEQ ID NO: 12116 - DNA, 24 bp, Homo sapiens
tcacgcctgtaatcccagcatttt

SEQ ID NO: 12117 - DNA, 32 bp, Homo sapiens
gatttgttaatttccatgggaagccatgatgg

SEQ ID NO: 12118 - DNA, 32 bp, Homo sapiens
cagcctactttccaagcggagccatgtctggt

SEQ ID NO: 12119 - DNA, 24 bp, Homo sapiens
aatttcacatgtagtagcttctga

SEQ ID NO: 12120 - DNA, 32 bp, Homo sapiens
cagcagaattttctccccgtcttccccttcct

SEQ ID NO: 12121 - DNA, 24 bp, Homo sapiens
tcacgcctgtaaccccagcacttt

SEQ ID NO: 12122 - DNA, 32 bp, Homo sapiens
tccagatttgcccccgccttgttttgaaagcc

SEQ ID NO: 12123 - DNA, 19 bp, Homo sapiens
gccacctcatcacccagag

SEQ ID NO: 12124 - DNA, 21 bp, Homo sapiens
gccatagcacccagcccagaa

SEQ ID NO: 12125 - DNA, 32 bp, Homo sapiens
gttatcgaactttctttgttgctgctagttaa

SEQ ID NO: 12126 - DNA, 32 bp, Homo sapiens
caactcactgatttacttctagcaatagcatg

SEQ ID NO: 12127 - DNA, 32 bp, Homo sapiens
gcccttgagcctggctggagtaggtggaatat

SEQ ID NO: 12128 - DNA, 32 bp, Homo sapiens
agcttcctgagtagatgggattacaggcgcct

SEQ ID NO: 12129 - DNA, 32 bp, Homo sapiens
ttctgtcacctagggtggagtgcagtggcaca

SEQ ID NO: 12130 - DNA, 32 bp, Homo sapiens
cttcgtgtttgctgctggagtgactgtgtgtt

SEQ ID NO: 12131 - DNA, 32 bp, Homo sapiens
tggggttcaagcaatctgcccacctcagcctc

SEQ ID NO: 12132 - DNA, 32 bp, Homo sapiens
tggacaacagctgggagctcaacatggacttg

SEQ ID NO: 12133 - DNA, 23 bp, Homo sapiens
ctgttgccaggctggagtgcagt

SEQ ID NO: 12134 - DNA, 21 bp, Homo sapiens
catgcctgacccacacacttt

SEQ ID NO: 12135 - DNA, 19 bp, Homo sapiens
cctataatcccagcacttt

SEQ ID NO: 12136 - DNA, 32 bp, Homo sapiens
ttgggctcaagcaatcctcctgcctcagcctc

SEQ ID NO: 12137 - DNA, 32 bp, Homo sapiens
atcatctctcacaaaacacaggcaacccagac

SEQ ID NO: 12138 - DNA, 19 bp, Homo sapiens
gctctcctgccacccagag

SEQ ID NO: 12139 - DNA, 32 bp, Homo sapiens
gctccttctcttctcccatctgctaccagagc

SEQ ID NO: 12140 - DNA, 32 bp, Homo sapiens
gaacccaggaggcagaggttgcaatgagccaa

SEQ ID NO: 12141 - DNA, 32 bp, Homo sapiens
gaacctgggaggcaggggttgcagtgagctga

SEQ ID NO: 12142 - DNA, 32 bp, Homo sapiens
tgccttcaggccacagtcgtgctgctagaaca

SEQ ID NO: 12143 - DNA, 32 bp, Homo sapiens
tcctgccgcccaggccttggaggtactgctgc

SEQ ID NO: 12144 - DNA, 32 bp, Homo sapiens
gaacctgggaggcagaggttgcaatgagctga

SEQ ID NO: 12145 - DNA, 32 bp, Homo sapiens
aaacccagaaggcaggggttgcagtgagccaa

SEQ ID NO: 12146 - DNA, 32 bp, Homo sapiens
cccgcccagctttcccaggggcacagctctag

SEQ ID NO: 12147 - DNA, 32 bp, Homo sapiens
cacctgtgtaggtctcacctgtgccaggtgta

SEQ ID NO: 12148 - DNA, 32 bp, Homo sapiens
acttattatgtattaggttctttgccagatgt

SEQ ID NO: 12149 - DNA, 32 bp, Homo sapiens
ggccccgtactgcttccatcagctccagcccc

SEQ ID NO: 12150 - DNA, 21 bp, Homo sapiens
gggcctcctctcctcctctca

SEQ ID NO: 12151 - DNA, 32 bp, Homo sapiens
gcccctgccctctctcctttgcccctcagtct

SEQ ID NO: 12152 - DNA, 32 bp, Homo sapiens
ttgtcaaaaatcaggctggagtgcagtggcat

SEQ ID NO: 12153 - DNA, 32 bp, Homo sapiens
ctcttgtcccccaggctggagtggtgcagtgg

SEQ ID NO: 12154 - DNA, 32 bp, Homo sapiens
gctctgtcacccgggctggagtgtaacgtggc

SEQ ID NO: 12155 - DNA, 32 bp, Homo sapiens
aagctttaggcaggcttcctggaactactgtt

SEQ ID NO: 12156 - DNA, 32 bp, Homo sapiens
cccagaaggaggcagagctccgcagctggatc

SEQ ID NO: 12157 - DNA, 32 bp, Homo sapiens
tcctgaatgctaggctggaaagtggtgcctgt

SEQ ID NO: 12158 - DNA, 32 bp, Homo sapiens
ccagccaggcctgggcagtgacctctttctct

SEQ ID NO: 12159 - DNA, 32 bp, Homo sapiens
cctgaacccccaggctggagtacagtggcagg

SEQ ID NO: 12160 - DNA, 32 bp, Homo sapiens
cccatggcccaggctccaggaagtgccttggg

SEQ ID NO: 12161 - DNA, 32 bp, Homo sapiens
gaagagagcgtgcctcaggttacttgaacttg

SEQ ID NO: 12162 - DNA, 32 bp, Homo sapiens
ccagacggtatctcctggatgccagtgagcgg

SEQ ID NO: 12163 - DNA, 32 bp, Homo sapiens
tcggcttcaagcaattctcctgcctcagcctc

SEQ ID NO: 12164 - DNA, 32 bp, Homo sapiens
ctctctagtgaatttgctaactgtgaagaaca

SEQ ID NO: 12165 - DNA, 32 bp, Homo sapiens
cgtcaccccctctctgcttgcagacagtgcca

SEQ ID NO: 12166 - DNA, 32 bp, Homo sapiens
tctcttcccttctaacttgacagggtcttgct

SEQ ID NO: 12167 - DNA, 32 bp, Homo sapiens
gctcttttgcccagactggagtgaagtagcat

SEQ ID NO: 12168 - DNA, 32 bp, Homo sapiens
taattcaggaggtagaatggagcttgagatca

SEQ ID NO: 12169 - DNA, 32 bp, Homo sapiens
gctctgtcacccagcctggaatgtagtggcat

SEQ ID NO: 12170 - DNA, 32 bp, Homo sapiens
acttctgcctcctgggttcaagcgattcccct

SEQ ID NO: 12171 - DNA, 32 bp, Homo sapiens
gacaaagtcaaataaacccccaaggacgacac

SEQ ID NO: 12172 - DNA, 32 bp, Homo sapiens
agcctcctgagtagctgggattgcaggtgccc

SEQ ID NO: 12173 - DNA, 32 bp, Homo sapiens
ctctgtcacccaggctggagtgcaatggcaag

SEQ ID NO: 12174 - DNA, 31 bp, Homo sapiens
ccaaattacactgaatctaggaggggagttg

SEQ ID NO: 12175 - DNA, 32 bp, Homo sapiens
tgggagtaggaatgtgaccgaaaacaagttgt

SEQ ID NO: 12176 - DNA, 32 bp, Homo sapiens
ggcaaatggggagtagagagaaaacaggcgag

SEQ ID NO: 12177 - DNA, 32 bp, Homo sapiens
caccaagcattactccccatcgccagctgatg

SEQ ID NO: 12178 - DNA, 32 bp, Homo sapiens
acaccacagcttctccccagcttggtgccttt

SEQ ID NO: 12179 - DNA, 32 bp, Homo sapiens
ggctcgtccctcctccccatctcggccctgag

SEQ ID NO: 12180 - DNA, 20 bp, Homo sapiens
ctgctgtcctatgtgcaggt

SEQ ID NO: 12181 - DNA, 22 bp, Homo sapiens
gtcgcccaggctggagtgtagt

SEQ ID NO: 12182 - DNA, 32 bp, Homo sapiens
atgtcctccagaggagcttcctcctccaggcc

SEQ ID NO: 12183 - DNA, 32 bp, Homo sapiens
gtgctggcccctggctggaggggagggcagtg

SEQ ID NO: 12184 - DNA, 26 bp, Homo sapiens
gtgcccacatctattccatctggtca

SEQ ID NO: 12185 - DNA, 32 bp, Homo sapiens
ggctgggcgtgctagaggttgcagcatgagac

SEQ ID NO: 12186 - DNA, 32 bp, Homo sapiens
gggggaggctgggagaggttgggtgctctcct

SEQ ID NO: 12187 - DNA, 32 bp, Homo sapiens
aaaatctgaacagggccaggtgcagtggctca

SEQ ID NO: 12188 - DNA, 32 bp, Homo sapiens
gagcccaggaggttgaggctgcagtgagctat

SEQ ID NO: 12189 - DNA, 32 bp, Homo sapiens
gagcccaggaggtcaaggctgcagtgagccgt

SEQ ID NO: 12190 - DNA, 32 bp, Homo sapiens
gagcccaggaggtcgaggctgcagtgagccat

SEQ ID NO: 12191 - DNA, 32 bp, Homo sapiens
gataacccaagtgtcccacaggccaaggtaca

SEQ ID NO: 12192 - DNA, 32 bp, Homo sapiens
gtttttcctagaggagagattagtacctattc

SEQ ID NO: 12193 - DNA, 32 bp, Homo sapiens
gagcctgggaggtcgaggctgcagtgagctgt

SEQ ID NO: 12194 - DNA, 32 bp, Homo sapiens
acctccgcctcccaggttcaagcggttctcct

SEQ ID NO: 12195 - DNA, 32 bp, Homo sapiens
gcctccgcctcccaggttcaagcgattctcct

SEQ ID NO: 12196 - DNA, 28 bp, Homo sapiens
atggccccaattcttgcctcatcctatg

SEQ ID NO: 12197 - DNA, 32 bp, Homo sapiens
agcctctctgcagcccctcttttccttcaatc

SEQ ID NO: 12198 - DNA, 32 bp, Homo sapiens
gggtaccgtcttctccctattccctctctctc

SEQ ID NO: 12199 - DNA, 32 bp, Homo sapiens
tcttgttggcctgggaacttcttggaacttta

SEQ ID NO: 12200 - DNA, 32 bp, Homo sapiens
acagccttcagccttgaactgcagcgtcacct

SEQ ID NO: 12201 - DNA, 32 bp, Homo sapiens
tacttaggagcctctttgtagggactgtgcct

SEQ ID NO: 12202 - DNA, 32 bp, Homo sapiens
tctgatagtgcccttgctcttctgtctgtcat

SEQ ID NO: 12203 - DNA, 32 bp, Homo sapiens
ctcttgttgcccaggcggagtacaatggtggg

SEQ ID NO: 12204 - DNA, 32 bp, Homo sapiens
tccctgtcacccagccatggtgtggtccaggc

SEQ ID NO: 12205 - DNA, 24 bp, Homo sapiens
gggccacagcccttttagggcatt

SEQ ID NO: 12206 - DNA, 32 bp, Homo sapiens
tggcactgctccctctgaagtgcagtgggatc

SEQ ID NO: 12207 - DNA, 32 bp, Homo sapiens
ggttcttgacctggtggatgtggctgcagtcc

SEQ ID NO: 12208 - DNA, 32 bp, Homo sapiens
agccctaaagtcccctgctccctggacttctc

SEQ ID NO: 12209 - DNA, 32 bp, Homo sapiens
acctccgccccccaggttcaagcgattctgcc

SEQ ID NO: 12210 - DNA, 32 bp, Homo sapiens
cagggcgggaggcggcggcgcgtgggggcggg

SEQ ID NO: 12211 - DNA, 32 bp, Homo sapiens
cccttctcttttaatggagacagggtcttgca

SEQ ID NO: 12212 - DNA, 32 bp, Homo sapiens
cgggagccaggcgctgtggacagggtctgtcc

SEQ ID NO: 12213 - DNA, 32 bp, Homo sapiens
tcatcctcgttggcttctctgccttcccccac

SEQ ID NO: 12214 - DNA, 32 bp, Homo sapiens
gtgtctgtccgcagactgggatgagtctactc

SEQ ID NO: 12215 - DNA, 16 bp, Homo sapiens
agggatcctccagctc

SEQ ID NO: 12216 - DNA, 22 bp, Homo sapiens
aacagtaatggaagtgcggcca

SEQ ID NO: 12217 - DNA, 32 bp, Homo sapiens
ctctgtcacccaggttggagtgccatggcatg

SEQ ID NO: 12218 - DNA, 32 bp, Homo sapiens
gaaccccagaggcagaggctgaagtgagccaa

SEQ ID NO: 12219 - DNA, 32 bp, Homo sapiens
agcctctggagtagctgggactacagacatgc

SEQ ID NO: 12220 - DNA, 32 bp, Homo sapiens
tgatgttgcccaggctagagtgcagtggcaca

SEQ ID NO: 12221 - DNA, 32 bp, Homo sapiens
gctctgtcgccagactggagtgcagtggcgca

SEQ ID NO: 12222 - DNA, 31 bp, Homo sapiens
ccgggacaagaccagggcaggagggagccgg

SEQ ID NO: 12223 - DNA, 32 bp, Homo sapiens
ctcttgtcaccgaggctggagtgcaatgacat

SEQ ID NO: 12224 - DNA, 32 bp, Homo sapiens
tgagggtacctgcacagtttgattcttttcca

SEQ ID NO: 12225 - DNA, 32 bp, Homo sapiens
gtacccagcctatctttttgatacttttgaat

SEQ ID NO: 12226 - DNA, 32 bp, Homo sapiens
ctctcttgcacgctctctcttctctcccaggc

SEQ ID NO: 12227 - DNA, 32 bp, Homo sapiens
ctgtgccgtcttctcctgctctggaatcaaag

SEQ ID NO: 12228 - DNA, 32 bp, Homo sapiens
caagttccacaggtctgctaccacaggccatc

SEQ ID NO: 12229 - DNA, 21 bp, Homo sapiens
cagggtgtcttccttcagccc

SEQ ID NO: 12230 - DNA, 32 bp, Homo sapiens
ccacccttcaggagtttccagagaccaagaat

SEQ ID NO: 12231 - DNA, 32 bp, Homo sapiens
actgcaatgatgttcttcctggaattcatgaa

SEQ ID NO: 12232 - DNA, 32 bp, Homo sapiens
ttcaccctgttctagaagcacatggttgtcct

SEQ ID NO: 12233 - DNA, 32 bp, Homo sapiens
tctgaggtgacggactgagacgcatctggtcc

SEQ ID NO: 12234 - DNA, 32 bp, Homo sapiens
ctgggttcaagcaattctccagcctctgcctc

SEQ ID NO: 12235 - DNA, 32 bp, Homo sapiens
cacaaagtcagctcctctcccaccacaggctc

SEQ ID NO: 12236 - DNA, 32 bp, Homo sapiens
ttcactgggctcacctgcttctgaaaacggct

SEQ ID NO: 12237 - DNA, 24 bp, Homo sapiens
ttgttgcctaggctggagtgcaat

SEQ ID NO: 12238 - DNA, 24 bp, Homo sapiens
ctgttgcccaggctggagtgcaat

SEQ ID NO: 12239 - DNA, 32 bp, Homo sapiens
aagtcctttgtcacttctcttgccttagtgtg

SEQ ID NO: 12240 - DNA, 32 bp, Homo sapiens
aaaatacccaggggttaagaccacagaaggct

SEQ ID NO: 12241 - DNA, 32 bp, Homo sapiens
gatttgattcgccctcctccctgtcatagagc

SEQ ID NO: 12242 - DNA, 32 bp, Homo sapiens
ctgcttcatccctctcaagtatggctcagcta

SEQ ID NO: 12243 - DNA, 32 bp, Homo sapiens
ctgtgttgcccaggctagagtgcagtggtgcc

SEQ ID NO: 12244 - DNA, 32 bp, Homo sapiens
tcttgttgcccaggctggagtgcaatgcgcga

SEQ ID NO: 12245 - DNA, 32 bp, Homo sapiens
cgaaatcaatgttattctccctcccaccactt

SEQ ID NO: 12246 - DNA, 32 bp, Homo sapiens
ggctcatgcctgtaatcccagcactttgagag

SEQ ID NO: 12247 - DNA, 32 bp, Homo sapiens
ctcttccgcccaggctgcagtgcagtggcatg

SEQ ID NO: 12248 - DNA, 32 bp, Homo sapiens
tccctacatcttctcttctgactttggctaca

SEQ ID NO: 12249 - DNA, 31 bp, Homo sapiens
cctgcaagcacagggctaaggagggatagag

SEQ ID NO: 12250 - DNA, 32 bp, Homo sapiens
aaagacctatcaaaatgtcccaccttaagccc

SEQ ID NO: 12251 - DNA, 23 bp, Homo sapiens
gtcgcccaggctagagtgcagtg

SEQ ID NO: 12252 - DNA, 32 bp, Homo sapiens
tgcctctgagtctgaatctcccaaagagagaa

SEQ ID NO: 12253 - DNA, 32 bp, Homo sapiens
tgcagctgtcttctcctcagtgctggcgctct

SEQ ID NO: 12254 - DNA, 32 bp, Homo sapiens
gagtgtgtgctgccgttcattaccacggagat

SEQ ID NO: 12255 - DNA, 23 bp, Homo sapiens
gtcacccaggctggagtgcgatg

SEQ ID NO: 12256 - DNA, 23 bp, Homo sapiens
gtcgcccaggctggagtgcaatg

SEQ ID NO: 12257 - DNA, 32 bp, Homo sapiens
ttgaggcatgctgggcctggtgcagtgatggc

SEQ ID NO: 12258 - DNA, 32 bp, Homo sapiens
cagccaaggccagacttcctagtggaagagca

SEQ ID NO: 12259 - DNA, 32 bp, Homo sapiens
gaaccagggaggcagaggctgcggtgagccga

SEQ ID NO: 12260 - DNA, 32 bp, Homo sapiens
agagtacagaaattcattatgctgctaattta

SEQ ID NO: 12261 - DNA, 32 bp, Homo sapiens
agtacagcaagaggagagaggtcaagcgagaa

SEQ ID NO: 12262 - DNA, 32 bp, Homo sapiens
ttgatttgaacaaattttctggtgctaagtct

SEQ ID NO: 12263 - DNA, 32 bp, Homo sapiens
ctctgtcacccaggctggagtgcaatgggcac

SEQ ID NO: 12264 - DNA, 23 bp, Homo sapiens
ctgtcgccagactggagtgcagt

SEQ ID NO: 12265 - DNA, 32 bp, Homo sapiens
tgatgattacagtctagagttacttgaaatgg

SEQ ID NO: 12266 - DNA, 32 bp, Homo sapiens
gggtgagtctgttttcctctctggacctcagt

SEQ ID NO: 12267 - DNA, 32 bp, Homo sapiens
ctgctttgtgttcctctcccagctccatctct

SEQ ID NO: 12268 - DNA, 32 bp, Homo sapiens
agaaggccaccccgcctggaggcacaggccat

SEQ ID NO: 12269 - DNA, 32 bp, Homo sapiens
aaatccttcagctgattctcagtctagtaaac

SEQ ID NO: 12270 - DNA, 32 bp, Homo sapiens
ctcttattgcccaggctggagtgcagtggcac

SEQ ID NO: 12271 - DNA, 19 bp, Homo sapiens
caggctctttctccagccc

SEQ ID NO: 12272 - DNA, 32 bp, Homo sapiens
ttgagacagagtttcgctcttgttgctgaggc

SEQ ID NO: 12273 - DNA, 32 bp, Homo sapiens
ctctgttgctgaggctggagtgcagtgatgtg

SEQ ID NO: 12274 - DNA, 32 bp, Homo sapiens
tcttgcataaggcagttcctggagacccagca

SEQ ID NO: 12275 - DNA, 32 bp, Homo sapiens
gaggtctgcctgtttcgtccccagaaacttga

SEQ ID NO: 12276 - DNA, 32 bp, Homo sapiens
atgtggcagtttcaaaggattacttgatgcaa

SEQ ID NO: 12277 - DNA, 32 bp, Homo sapiens
agccacctgagtagcagggattacaggtgtgt

SEQ ID NO: 12278 - DNA, 32 bp, Homo sapiens
tttgatactatttggcttaatcatcttcactt

SEQ ID NO: 12279 - DNA, 32 bp, Homo sapiens
ccagtgtgagtgctgctctttccacctgcctt

SEQ ID NO: 12280 - DNA, 32 bp, Homo sapiens
tcccctctctcttgtccccaggcacagcctag

SEQ ID NO: 12281 - DNA, 32 bp, Homo sapiens
atcctattagttctgtccctccagagaaccct

SEQ ID NO: 12282 - DNA, 24 bp, Homo sapiens
ctggccaacatggcgaaacccctc

SEQ ID NO: 12283 - DNA, 24 bp, Homo sapiens
ctggccaacatggtgaaacccttc

SEQ ID NO: 12284 - DNA, 32 bp, Homo sapiens
ctcttgtcacccaggctggagtgcagtggtgc

SEQ ID NO: 12285 - DNA, 32 bp, Homo sapiens
ctcttgtcacccaggctggagtgtagtggtgt

SEQ ID NO: 12286 - DNA, 32 bp, Homo sapiens
caaaaattcccactgtcatagctataggctgt

SEQ ID NO: 12287 - DNA, 32 bp, Homo sapiens
ctcagtcacatcctgtcttccttacatctttg

SEQ ID NO: 12288 - DNA, 32 bp, Homo sapiens
tggagtcctagagaggcagacaatgttgatga

SEQ ID NO: 12289 - DNA, 32 bp, Homo sapiens
aggcagggcagccaggggctgcagtgaaatgg

SEQ ID NO: 12290 - DNA, 32 bp, Homo sapiens
catctgggcgccgggacgctgcagtgatcccc

SEQ ID NO: 12291 - DNA, 32 bp, Homo sapiens
aacctctagagtagctgggattacaggcgcat

SEQ ID NO: 12292 - DNA, 32 bp, Homo sapiens
cgtgagacgccaccattcctggaaaccacagt

SEQ ID NO: 12293 - DNA, 32 bp, Homo sapiens
acctccaccttccgggttcaagtgattctcct

SEQ ID NO: 12294 - DNA, 27 bp, Homo sapiens
gggagacccacagctaagacaccggga

SEQ ID NO: 12295 - DNA, 24 bp, Homo sapiens
tcatgcctgtgatcctagcacttt

SEQ ID NO: 12296 - DNA, 32 bp, Homo sapiens
gaaggtaatccggagtggcaatggagtggctg

SEQ ID NO: 12297 - DNA, 32 bp, Homo sapiens
ggggcaaggctccgagggcagcattcagtagc

SEQ ID NO: 12298 - DNA, 24 bp, Homo sapiens
tggcaggatctcagcttactgcag

SEQ ID NO: 12299 - DNA, 32 bp, Homo sapiens
ggccttcatccctctctacgataaggttgcag

SEQ ID NO: 12300 - DNA, 32 bp, Homo sapiens
tgtctgtcacccaggctggagtacagtggcat

SEQ ID NO: 12301 - DNA, 32 bp, Homo sapiens
aaaaatacatctccctctgaccacagactcct

SEQ ID NO: 12302 - DNA, 32 bp, Homo sapiens
tcagatagatcattgttagatatttcacattt

SEQ ID NO: 12303 - DNA, 32 bp, Homo sapiens
gaacctgggagacagaggttgcagtgagccaa

SEQ ID NO: 12304 - DNA, 32 bp, Homo sapiens
actccagtgtggcatcatgtggcagctgctcc

SEQ ID NO: 12305 - DNA, 28 bp, Homo sapiens
aacttctgaagtgctgtctttttacatt

SEQ ID NO: 12306 - DNA, 32 bp, Homo sapiens
gaacctgggaggcagaggttgcagtgaaccaa

SEQ ID NO: 12307 - DNA, 32 bp, Homo sapiens
gaacctaggaggcagaggttgcagtgaaccga

SEQ ID NO: 12308 - DNA, 32 bp, Homo sapiens
ctgggctcaagcaatcctcccgcttcagcctc

SEQ ID NO: 12309 - DNA, 32 bp, Homo sapiens
gttcaagggtcttgtacccccacctcagctgg

SEQ ID NO: 12310 - DNA, 32 bp, Homo sapiens
aacctccacctccgggttcaagcgattcttgt

SEQ ID NO: 12311 - DNA, 32 bp, Homo sapiens
ctgggctcaagcagttctcccacctcagcctc

SEQ ID NO: 12312 - DNA, 32 bp, Homo sapiens
ccaggttcaagcaattatcctgcctcaggctc

SEQ ID NO: 12313 - DNA, 32 bp, Homo sapiens
ctgggttcaagcaattcttctgcctcagcctt

SEQ ID NO: 12314 - DNA, 32 bp, Homo sapiens
tcttgggtttcagtgatttttctgcctcggcc

SEQ ID NO: 12315 - DNA, 17 bp, Homo sapiens
ctaagtcggctccggga

SEQ ID NO: 12316 - DNA, 32 bp, Homo sapiens
gaggggaggagaggagaggagaggaaccgtca

SEQ ID NO: 12317 - DNA, 32 bp, Homo sapiens
ggcccttcagcctttgggaacagggtcagcat

SEQ ID NO: 12318 - DNA, 32 bp, Homo sapiens
cctaatttcaaaacatcaccttgccaccctga

SEQ ID NO: 12319 - DNA, 32 bp, Homo sapiens
agctgctgctatgtctctcttctgtcttattc

SEQ ID NO: 12320 - DNA, 32 bp, Homo sapiens
ggggaggtgcccaggtgggtggaccagtactc

SEQ ID NO: 12321 - DNA, 32 bp, Homo sapiens
ccatggtagttgctgctcatggttctgtctgt

SEQ ID NO: 12322 - DNA, 32 bp, Homo sapiens
agtggtcaccccatgggacaggcacagctact

SEQ ID NO: 12323 - DNA, 32 bp, Homo sapiens
gcctcgacctcctgggctcaagcaatcctcct

SEQ ID NO: 12324 - DNA, 32 bp, Homo sapiens
tttccagcctccagcctctcatttctggggct

SEQ ID NO: 12325 - DNA, 32 bp, Homo sapiens
cgaggaggagaagagcaaagaaaagcagtccg

SEQ ID NO: 12326 - DNA, 32 bp, Homo sapiens
aagatatagagaggagaggagtgaagaaaagg

SEQ ID NO: 12327 - DNA, 32 bp, Homo sapiens
agcgtcctgagtagctgggactacaggcgcgc

SEQ ID NO: 12328 - DNA, 32 bp, Homo sapiens
ccagcctgactgtggttcccagctccagccct

SEQ ID NO: 12329 - DNA, 32 bp, Homo sapiens
atgcccaacctatcctgttcttttaattgaaa

SEQ ID NO: 12330 - DNA, 16 bp, Homo sapiens
tcctcccctccaggta

SEQ ID NO: 12331 - DNA, 32 bp, Homo sapiens
cggaggcggaggcggaggttgcagtgagccaa

SEQ ID NO: 12332 - DNA, 32 bp, Homo sapiens
aagcttattgcattccacactgatctcttggc

SEQ ID NO: 12333 - DNA, 32 bp, Homo sapiens
gaacccgggaggtagaggttgcagtgagccga

SEQ ID NO: 12334 - DNA, 32 bp, Homo sapiens
gaacccgggaggcagaggttgcagtgagtcga

SEQ ID NO: 12335 - DNA, 32 bp, Homo sapiens
gaactcaggaggcagaggttgcagtgagccaa

SEQ ID NO: 12336 - DNA, 32 bp, Homo sapiens
gaacccaggaggcagaggttgcagtgagtcaa

SEQ ID NO: 12337 - DNA, 32 bp, Homo sapiens
gaacccaggaggtagaggttgcagtgagccaa

SEQ ID NO: 12338 - DNA, 32 bp, Homo sapiens
gaacccaggaggcagaggttgcggtgagtcga

SEQ ID NO: 12339 - DNA, 24 bp, Homo sapiens
tcatacctgtaatcccagcacttt

SEQ ID NO: 12340 - DNA, 32 bp, Homo sapiens
tgtcacccaggcgggagtggtgcaatggcttg

SEQ ID NO: 12341 - DNA, 32 bp, Homo sapiens
ctctgtcaccaaggctggagtgcattggtgca

SEQ ID NO: 12342 - DNA, 32 bp, Homo sapiens
aaggaccaaagacaagtgaattttctgagggt

SEQ ID NO: 12343 - DNA, 19 bp, Homo sapiens
ccacaccacgaaagatcca

SEQ ID NO: 12344 - DNA, 31 bp, Homo sapiens
cctaccaacaacatacagggaagagatacag

SEQ ID NO: 12345 - DNA, 32 bp, Homo sapiens
ttgctcttacccaggctgagtgcagtggcaga

SEQ ID NO: 12346 - DNA, 32 bp, Homo sapiens
aacccaggagaggaagaaagaaaggagagagg

SEQ ID NO: 12347 - DNA, 20 bp, Homo sapiens
cagggaaatgtcttcagccc

SEQ ID NO: 12348 - DNA, 32 bp, Homo sapiens
atgacaccaagtgcccggataaagtcagcttc

SEQ ID NO: 12349 - DNA, 32 bp, Homo sapiens
ccatgttgcccaggctggtctcaaacttgtga

SEQ ID NO: 12350 - DNA, 32 bp, Homo sapiens
cctgggccatccattccattttgttccacatt

SEQ ID NO: 12351 - DNA, 32 bp, Homo sapiens
ggcctcctgaagtgttgggattacaggcgtga

SEQ ID NO: 12352 - DNA, 32 bp, Homo sapiens
taaccccaacgcacaggaaaaggtagcttacc

SEQ ID NO: 12353 - DNA, 32 bp, Homo sapiens
ctctgttgcccaggctagagtgcactggtggt

SEQ ID NO: 12354 - DNA, 22 bp, Homo sapiens
gcattcacccccagtcacaatg

SEQ ID NO: 12355 - DNA, 31 bp, Homo sapiens
tggcggcaacatgcaagaaggagggactgtc

SEQ ID NO: 12356 - DNA, 32 bp, Homo sapiens
ctgggcccaagtgatccttccacctcagtctc

SEQ ID NO: 12357 - DNA, 32 bp, Homo sapiens
ggtgccatcagcaggaggcactgtgaagcacc

SEQ ID NO: 12358 - DNA, 32 bp, Homo sapiens
gaggtgcaggcctcgtcacctgcagaggtgcc

SEQ ID NO: 12359 - DNA, 32 bp, Homo sapiens
ccgctctcctccccggcacaggcagggggtct

SEQ ID NO: 12360 - DNA, 32 bp, Homo sapiens
acttgaacccaggaggtgttgcagtgaaccaa

SEQ ID NO: 12361 - DNA, 32 bp, Homo sapiens
atgccagcgccaacaggaggctgtctggacac

SEQ ID NO: 12362 - DNA, 32 bp, Homo sapiens
gcctccgccacctgggttcaagcaattctcct

SEQ ID NO: 12363 - DNA, 32 bp, Homo sapiens
gtgacttctgtggtgaggaggcttcagtgttc

SEQ ID NO: 12364 - DNA, 32 bp, Homo sapiens
ccaggtgcaatctactggaaatgtagcactta

SEQ ID NO: 12365 - DNA, 32 bp, Homo sapiens
gggaggccaaggtgagcaagtcacttgaggtc

SEQ ID NO: 12366 - DNA, 32 bp, Homo sapiens
ttccgaagtctacctagtgccccagccgaacc

SEQ ID NO: 12367 - DNA, 32 bp, Homo sapiens
aaagacctttgtcaaggagagtgcagtcaacc

SEQ ID NO: 12368 - DNA, 32 bp, Homo sapiens
gccttctctgcagtcccttctgccctgccggg

SEQ ID NO: 12369 - DNA, 32 bp, Homo sapiens
tcctgtgctctgatgctacttctgcctagccc

SEQ ID NO: 12370 - DNA, 32 bp, Homo sapiens
gaacctgggaggctgaagttgcagtgagccga

SEQ ID NO: 12371 - DNA, 32 bp, Homo sapiens
cagctcatctctggaagcctttgctactcaag

SEQ ID NO: 12372 - DNA, 32 bp, Homo sapiens
agcagaaatggctccaaaatggcagctcatca

SEQ ID NO: 12373 - DNA, 32 bp, Homo sapiens
gcctccgcctcctgggttcaagtgattctcct

SEQ ID NO: 12374 - DNA, 32 bp, Homo sapiens
gccttcgcctcccgggttcaagtgattctcct

SEQ ID NO: 12375 - DNA, 32 bp, Homo sapiens
cagttcccaagtgtccaacaagaaggcctggt

SEQ ID NO: 12376 - DNA, 32 bp, Homo sapiens
caaagcctgcagcgtggcaagcactttgcaca

SEQ ID NO: 12377 - DNA, 32 bp, Homo sapiens
agcctcctgagtagctgggattacaggcgcgt

SEQ ID NO: 12378 - DNA, 32 bp, Homo sapiens
agcctcctgagcagctgggattacaggtgcgt

SEQ ID NO: 12379 - DNA, 32 bp, Homo sapiens
tgtggaccagaactttcaccttgtgaatgcat

SEQ ID NO: 12380 - DNA, 32 bp, Homo sapiens
ggattatgagcttctttcaagggctaaggctg

SEQ ID NO: 12381 - DNA, 32 bp, Homo sapiens
gtgagggccaagggggacccccagaaaaaggt

SEQ ID NO: 12382 - DNA, 32 bp, Homo sapiens
gctctgtcgcccaggctggagtgcagtggtgc

SEQ ID NO: 12383 - DNA, 32 bp, Homo sapiens
actctgtcacccaggctggagtgtagtggtgt

SEQ ID NO: 12384 - DNA, 32 bp, Homo sapiens
cctctgtcccccaggctggagtgcagtggtgc

SEQ ID NO: 12385 - DNA, 32 bp, Homo sapiens
actctgtcacccaggctggagtgcagtggtgc

SEQ ID NO: 12386 - DNA, 32 bp, Homo sapiens
gctctgttgcccaggctggagtgcagtggtgt

SEQ ID NO: 12387 - DNA, 32 bp, Homo sapiens
acctgaacccccaggctggagtacagtggcag

SEQ ID NO: 12388 - DNA, 32 bp, Homo sapiens
agcctcctgagtagctgggattacaggcgcac

SEQ ID NO: 12389 - DNA, 32 bp, Homo sapiens
tcttgttgcccaggctggagtgcagtggtgcg

SEQ ID NO: 12390 - DNA, 28 bp, Homo sapiens
ctaggcctgacctgtgcctcatcccgtg

SEQ ID NO: 12391 - DNA, 32 bp, Homo sapiens
ggtcggatctgagatatctcccagggaggttc

SEQ ID NO: 12392 - DNA, 32 bp, Homo sapiens
agcagggtccattgctggcaatggatggccca

SEQ ID NO: 12393 - DNA, 32 bp, Homo sapiens
agcctcctgagtagctgggactacaggcttgt

SEQ ID NO: 12394 - DNA, 32 bp, Homo sapiens
gcacttctgcccaggcagcagggtgggtgggt

SEQ ID NO: 12395 - DNA, 32 bp, Homo sapiens
actccgttgcccaggctggagtacaatggtgc

SEQ ID NO: 12396 - DNA, 32 bp, Homo sapiens
tcccaccgcctaccttagcacagggtctctgc

SEQ ID NO: 12397 - DNA, 32 bp, Homo sapiens
gctctgttgcccaggctggagtacagtggtca

SEQ ID NO: 12398 - DNA, 32 bp, Homo sapiens
gaacccaggagatggaggttgcggtgagctga

SEQ ID NO: 12399 - DNA, 32 bp, Homo sapiens
taccattacatcctgatatctggggcttctga

SEQ ID NO: 12400 - DNA, 32 bp, Homo sapiens
gagaaggaagagaccaggtgggctctgagaca

SEQ ID NO: 12401 - DNA, 32 bp, Homo sapiens
taagtgggaagaggaagggagaggcaagcaac

SEQ ID NO: 12402 - DNA, 32 bp, Homo sapiens
gaatctgggaggcagaggttgctgtgagccga

SEQ ID NO: 12403 - DNA, 32 bp, Homo sapiens
gaacccaggagacggaggttgcggtgagttga

SEQ ID NO: 12404 - DNA, 32 bp, Homo sapiens
aggaggtggaggctgcaatgagctgagatagt

SEQ ID NO: 12405 - DNA, 32 bp, Homo sapiens
tagctgctgctgctgctgctgctgcaaactgt

SEQ ID NO: 12406 - DNA, 32 bp, Homo sapiens
acatcttctctcttccccatcttgcattggag

SEQ ID NO: 12407 - DNA, 28 bp, Homo sapiens
gagaggccaagggctgcctcctatcaga

SEQ ID NO: 12408 - DNA, 32 bp, Homo sapiens
ctcattttgctgctgattctagccccaaacaa

SEQ ID NO: 12409 - DNA, 32 bp, Homo sapiens
gtgtgatgggggagtgggtattacatgcattg

SEQ ID NO: 12410 - DNA, 32 bp, Homo sapiens
ctgctgcccaccctctgctccctgggatgggc

SEQ ID NO: 12411 - DNA, 32 bp, Homo sapiens
tcttgtagcccaggctggagtgcaatggcagg

SEQ ID NO: 12412 - DNA, 32 bp, Homo sapiens
ggcagcccctgggtagcttcaggatggggctg

SEQ ID NO: 12413 - DNA, 24 bp, Homo sapiens
tcatgccagcaatcctagcacttt

SEQ ID NO: 12414 - DNA, 32 bp, Homo sapiens
taccataaccgatgtgctggagctacacgact

SEQ ID NO: 12415 - DNA, 32 bp, Homo sapiens
tgccagtaaggttctacataccactgaccatc

SEQ ID NO: 12416 - DNA, 32 bp, Homo sapiens
atactaccagttctttatgagcactggaatgt

SEQ ID NO: 12417 - DNA, 32 bp, Homo sapiens
tcagaattaatctcttaaaatattttacagag

SEQ ID NO: 12418 - DNA, 32 bp, Homo sapiens
cagtttgtatccacctgctttcagaggaggaa

SEQ ID NO: 12419 - DNA, 28 bp, Homo sapiens
agcctgaaaagtgctgtcacgtcagcgg

SEQ ID NO: 12420 - DNA, 32 bp, Homo sapiens
ctgttgtcgcctaggctggagtgcaatgatgc

SEQ ID NO: 12421 - DNA, 32 bp, Homo sapiens
ccgggctcaagcaatcctcccacctcagcctc

SEQ ID NO: 12422 - DNA, 32 bp, Homo sapiens
ctttgtcccccaggctggagtgcgatggcagg

SEQ ID NO: 12423 - DNA, 23 bp, Homo sapiens
tggtacgatcttggctcactgca

SEQ ID NO: 12424 - DNA, 32 bp, Homo sapiens
ccgcggcgtcttctccacccacctgcgctggg

SEQ ID NO: 12425 - DNA, 24 bp, Homo sapiens
tcacatctgtaatccaagcacttt

SEQ ID NO: 12426 - DNA, 23 bp, Homo sapiens
tggcgcgatctcagctcactgca

SEQ ID NO: 12427 - DNA, 23 bp, Homo sapiens
tggtgcgatcttagctcactgca

SEQ ID NO: 12428 - DNA, 23 bp, Homo sapiens
tggcacgatctcggctcactgca

SEQ ID NO: 12429 - DNA, 23 bp, Homo sapiens
tggcgcgatctcggctcactaca

SEQ ID NO: 12430 - DNA, 24 bp, Homo sapiens
tggcacaatcaaagctcactgcag

SEQ ID NO: 12431 - DNA, 23 bp, Homo sapiens
tggtgcgatctcagctcaccgca

SEQ ID NO: 12432 - DNA, 32 bp, Homo sapiens
ggacctgggaggtggaggttgcggtgagctga

SEQ ID NO: 12433 - DNA, 32 bp, Homo sapiens
gggcccgggaggtcaaggttgcagtgagctgt

SEQ ID NO: 12434 - DNA, 32 bp, Homo sapiens
ggacctaggaggtggaggttgcagtgagctga

SEQ ID NO: 12435 - DNA, 32 bp, Homo sapiens
cctggattgctactttacccccatgaagcccg

SEQ ID NO: 12436 - DNA, 32 bp, Homo sapiens
gaagacgcttcctgggtttgaggagttcagtg

SEQ ID NO: 12437 - DNA, 32 bp, Homo sapiens
gagctcaggaggttgggtctgcagtgagctat

SEQ ID NO: 12438 - DNA, 32 bp, Homo sapiens
gggacagagagaggagaggaggaagattgagc

SEQ ID NO: 12439 - DNA, 32 bp, Homo sapiens
agccttctgagtagctggaattacaggctgtc

SEQ ID NO: 12440 - DNA, 32 bp, Homo sapiens
agtctcccaagtagctgggattacaggtgtgt

SEQ ID NO: 12441 - DNA, 32 bp, Homo sapiens
ctttgccctcaaggagttcaccagtttatggg

SEQ ID NO: 12442 - DNA, 32 bp, Homo sapiens
ccactctggctggcttctctcccctgccccaa

SEQ ID NO: 12443 - DNA, 21 bp, Homo sapiens
tcatgggtgcctcctgcccca

SEQ ID NO: 12444 - DNA, 23 bp, Homo sapiens
gtcgcccaggctggagcgcaatg

SEQ ID NO: 12445 - DNA, 32 bp, Homo sapiens
gtagaggcctaccttgaattaagggttatact

SEQ ID NO: 12446 - DNA, 32 bp, Homo sapiens
aagtctcctaaccttcctgggtctgttttctt

SEQ ID NO: 12447 - DNA, 32 bp, Homo sapiens
acaaggtagtaggaggaatgacttggtgtatc

SEQ ID NO: 12448 - DNA, 32 bp, Homo sapiens
tcagggccagttctggtgggcagcagagacct

SEQ ID NO: 12449 - DNA, 24 bp, Homo sapiens
tggcacaatcatggctcactgcag

SEQ ID NO: 12450 - DNA, 32 bp, Homo sapiens
tgtcttccttgggggaggagatggtgtcgttt

SEQ ID NO: 12451 - DNA, 32 bp, Homo sapiens
tgttcgcacatcctgtgtgtgcacagctgtcc

SEQ ID NO: 12452 - DNA, 32 bp, Homo sapiens
ggtgtgtggccaggctgcagagctgcgtgccg

SEQ ID NO: 12453 - DNA, 32 bp, Homo sapiens
ttttctcatttgccctttgagcacttttactt

SEQ ID NO: 12454 - DNA, 32 bp, Homo sapiens
aggccgtgcttaacaggaaaggacctaccaaa

SEQ ID NO: 12455 - DNA, 32 bp, Homo sapiens
ttctgtcacccaggctagagtacagtgggaac

SEQ ID NO: 12456 - DNA, 32 bp, Homo sapiens
ccatccagtagaggagaaagacgtcgagacag

SEQ ID NO: 12457 - DNA, 32 bp, Homo sapiens
ggaggaagaggaaggatgaagaaaaggaagaa

SEQ ID NO: 12458 - DNA, 32 bp, Homo sapiens
ctgctcacagccttctacatggtgctactgct

SEQ ID NO: 12459 - DNA, 32 bp, Homo sapiens
cagccatccccctcgtccagccgccgggccaa

SEQ ID NO: 12460 - DNA, 19 bp, Homo sapiens
atgaggaagatcttgtgga

SEQ ID NO: 12461 - DNA, 32 bp, Homo sapiens
ctcacagaaagaaacgaaagaaagcaaagcaa

SEQ ID NO: 12462 - DNA, 32 bp, Homo sapiens
gctctgttgcccacattggagtgcagtggcac

SEQ ID NO: 12463 - DNA, 32 bp, Homo sapiens
tgactatgaagaggaagaggaggacagtgatg

SEQ ID NO: 12464 - DNA, 32 bp, Homo sapiens
taactcttgctgctgctcactgtttgggtcca

SEQ ID NO: 12465 - DNA, 32 bp, Homo sapiens
gctgcagcgctgggctggtgtgcagtggtgcg

SEQ ID NO: 12466 - DNA, 32 bp, Homo sapiens
ctgaccttaagtgatccacccacctcggcctc

SEQ ID NO: 12467 - DNA, 32 bp, Homo sapiens
aaatagttcacgtttggagaattcttttgtac

SEQ ID NO: 12468 - DNA, 32 bp, Homo sapiens
gaacccgagaggtggaggttgcagtgaaccaa

SEQ ID NO: 12469 - DNA, 32 bp, Homo sapiens
gccagggtcttcctccccatctttccatcctt

SEQ ID NO: 12470 - DNA, 24 bp, Homo sapiens
tcatgcctcttgtcccagcacttt

SEQ ID NO: 12471 - DNA, 32 bp, Homo sapiens
ctgacctcaggtgatccgcccacctcggcctt

SEQ ID NO: 12472 - DNA, 32 bp, Homo sapiens
tccctggaagcctctttggaaaccacatagag

SEQ ID NO: 12473 - DNA, 32 bp, Homo sapiens
atttcttgccaagaggtctcccaggagatatt

SEQ ID NO: 12474 - DNA, 32 bp, Homo sapiens
ccaaagttaagcaaatgacaccattttcttcc

SEQ ID NO: 12475 - DNA, 32 bp, Homo sapiens
actctgtcacccaggctggagtgcaatgctgc

SEQ ID NO: 12476 - DNA, 32 bp, Homo sapiens
gaggcagagcttggcagccactgatggtggta

SEQ ID NO: 12477 - DNA, 32 bp, Homo sapiens
tttttatggagtttcatgttgtccactatagc

SEQ ID NO: 12478 - DNA, 32 bp, Homo sapiens
ctctgttgcctaggctggagtgaaagtggcgc

SEQ ID NO: 12479 - DNA, 32 bp, Homo sapiens
cgctgttgcccaggctctagtgcaatggcacg

SEQ ID NO: 12480 - DNA, 32 bp, Homo sapiens
gaacccgggaggcagaagttgcagtgaactga

SEQ ID NO: 12481 - DNA, 32 bp, Homo sapiens
agcctcccgagtagctgggattacaggcgccc

SEQ ID NO: 12482 - DNA, 32 bp, Homo sapiens
agcctcctgagtagctgggattacaggcgcct

SEQ ID NO: 12483 - DNA, 32 bp, Homo sapiens
gcccctgcagaggaatgaaactacttacaaca

SEQ ID NO: 12484 - DNA, 32 bp, Homo sapiens
ctgggctcaaatgatccttccacctcagcctc

SEQ ID NO: 12485 - DNA, 32 bp, Homo sapiens
tgacctatgcctgcaatccagcactttgggaa

SEQ ID NO: 12486 - DNA, 32 bp, Homo sapiens
tttccagaggtgtgtggctcttaagttgacat

SEQ ID NO: 12487 - DNA, 32 bp, Homo sapiens
aggcctcgactttgctggcacagggtcccagg

SEQ ID NO: 12488 - DNA, 32 bp, Homo sapiens
ttcacggcgattctccccatgggatcttgagg

SEQ ID NO: 12489 - DNA, 24 bp, Homo sapiens
tcacgcctgtaattctagcacttt

SEQ ID NO: 12490 - DNA, 32 bp, Homo sapiens
cacttcgggaggctgaggcaggtggatcactt

SEQ ID NO: 12491 - DNA, 32 bp, Homo sapiens
gcttgtaatgttctttacaggagtttaaaacg

SEQ ID NO: 12492 - DNA, 32 bp, Homo sapiens
gacaggcgtgtggggagttcactgtgacctag

SEQ ID NO: 12493 - DNA, 32 bp, Homo sapiens
gccaggagtttgattgcttacaacagctcttt

SEQ ID NO: 12494 - DNA, 32 bp, Homo sapiens
ccaggccagctctcctcccacaacagcttccc

SEQ ID NO: 12495 - DNA, 32 bp, Homo sapiens
tgaacccaggagacgaggttgcagtgagccga

SEQ ID NO: 12496 - DNA, 32 bp, Homo sapiens
agcctcccgagtagctgggattactggtgccc

SEQ ID NO: 12497 - DNA, 32 bp, Homo sapiens
ctcggtcacctaggctggagtgtagtggcgca

SEQ ID NO: 12498 - DNA, 32 bp, Homo sapiens
gcctccacttcctgggttcacatgattctcct

SEQ ID NO: 12499 - DNA, 18 bp, Homo sapiens
caggacaagctgactgaa

SEQ ID NO: 12500 - DNA, 22 bp, Homo sapiens
ggtgctgctgctgatccgggga

SEQ ID NO: 12501 - DNA, 32 bp, Homo sapiens
cctgggctaagtgatcctcccacctcagcctc

SEQ ID NO: 12502 - DNA, 23 bp, Homo sapiens
agctcctgcagccgccgccgctg

SEQ ID NO: 12503 - DNA, 23 bp, Homo sapiens
tggcacaatcaaggctcactgca

SEQ ID NO: 12504 - DNA, 21 bp, Homo sapiens
tgtcccaggctagagtgcagt

SEQ ID NO: 12505 - DNA, 32 bp, Homo sapiens
tacccaggacgtcagcatgactacctagtccc

SEQ ID NO: 12506 - DNA, 32 bp, Homo sapiens
tccgggggcccaggcggggaagtggggtgcgg

SEQ ID NO: 12507 - DNA, 32 bp, Homo sapiens
ctctgtcacccaggctggaatgacgaagtgaa

SEQ ID NO: 12508 - DNA, 32 bp, Homo sapiens
aggcggagtttccaagacttgggtgtcatcat

SEQ ID NO: 12509 - DNA, 22 bp, Homo sapiens
agtgagggaattagacctttgg

SEQ ID NO: 12510 - DNA, 32 bp, Homo sapiens
ggctcaagcctgtaatgtcagcactttaaaag

SEQ ID NO: 12511 - DNA, 27 bp, Homo sapiens
aagaccataggttagaaaaataactca

SEQ ID NO: 12512 - DNA, 32 bp, Homo sapiens
ttgcttcatcttctggctgttgtggcactgac

SEQ ID NO: 12513 - DNA, 32 bp, Homo sapiens
gctatcccatctgcccccatctggagctcggc

SEQ ID NO: 12514 - DNA, 32 bp, Homo sapiens
gaggggaagctgggagaaaggaggtcgaggag

SEQ ID NO: 12515 - DNA, 32 bp, Homo sapiens
ctgtgttgcggaagttctcactgtgaacttta

SEQ ID NO: 12516 - DNA, 23 bp, Homo sapiens
ccaggctctgactttcagcatca

SEQ ID NO: 12517 - DNA, 32 bp, Homo sapiens
ggatgttgcaccagaagagagtgcagtgttgg

SEQ ID NO: 12518 - DNA, 32 bp, Homo sapiens
cgcctaggctggagcgccgtggtacagtcttg

SEQ ID NO: 12519 - DNA, 32 bp, Homo sapiens
cttttgttgcccaggctggagttcagtggcgt

SEQ ID NO: 12520 - DNA, 28 bp, Homo sapiens
ccatctctaagtgctgaactcatccctg

SEQ ID NO: 12521 - DNA, 32 bp, Homo sapiens
ctggcgaggctgctggggttgcagcgggacag

SEQ ID NO: 12522 - DNA, 32 bp, Homo sapiens
agcctcctgagtagctgggattacaggcgccc

SEQ ID NO: 12523 - DNA, 32 bp, Homo sapiens
acatccccaacaacagcagggaccaacctatg

SEQ ID NO: 12524 - DNA, 32 bp, Homo sapiens
tgaacggccagagacttcctggtcaatactcc

SEQ ID NO: 12525 - DNA, 32 bp, Homo sapiens
gggctccggcctgggatgtttctgaactttgg

SEQ ID NO: 12526 - DNA, 32 bp, Homo sapiens
aggcccaggcctgggtttgtacttccacctcc

SEQ ID NO: 12527 - DNA, 32 bp, Homo sapiens
agcctcccgagtagctgggattacaggcgcct

SEQ ID NO: 12528 - DNA, 23 bp, Homo sapiens
tgtggaaaagaatggagagggga

SEQ ID NO: 12529 - DNA, 24 bp, Homo sapiens
tcatgcctgtaatctgagcacttt

SEQ ID NO: 12530 - DNA, 32 bp, Homo sapiens
ttgggttcaagcaattctcatgcctcggcctc

SEQ ID NO: 12531 - DNA, 32 bp, Homo sapiens
tcgttccaaggaggctcttcagtctcacagat

SEQ ID NO: 12532 - DNA, 32 bp, Homo sapiens
ggtttgttgtttgtttggattacttgaaaacc

SEQ ID NO: 12533 - DNA, 20 bp, Homo sapiens
tgatcttgccattgctccat

SEQ ID NO: 12534 - DNA, 32 bp, Homo sapiens
ctcttgttgcctaggctggagtgcagtggcgc

SEQ ID NO: 12535 - DNA, 32 bp, Homo sapiens
gaggaggagttagaggaggaggaggaggagga

SEQ ID NO: 12536 - DNA, 32 bp, Homo sapiens
aatggcacagaacttagcaacagcatgtgaat

SEQ ID NO: 12537 - DNA, 28 bp, Homo sapiens
gcactagcaagtgctgcctatgctgaga

SEQ ID NO: 12538 - DNA, 32 bp, Homo sapiens
atgccccctccaggctgagactgatgtgataa

SEQ ID NO: 12539 - DNA, 32 bp, Homo sapiens
ggatgatgatagcatggatgtgcctgaaatgc

SEQ ID NO: 12540 - DNA, 32 bp, Homo sapiens
acctctgcctcccgggttcaagcaattctcct

SEQ ID NO: 12541 - DNA, 32 bp, Homo sapiens
acctctgtctcccgggttcaagcaattctccc

SEQ ID NO: 12542 - DNA, 32 bp, Homo sapiens
acctccacctcctgggttcaagtgattttcct

SEQ ID NO: 12543 - DNA, 32 bp, Homo sapiens
gcaaaaagtctacatactttcatcctgactct

SEQ ID NO: 12544 - DNA, 32 bp, Homo sapiens
accctgttgccaggctggaatgcagtggcgcg

SEQ ID NO: 12545 - DNA, 32 bp, Homo sapiens
acctccacctcctgggttcaagcgattttctt

SEQ ID NO: 12546 - DNA, 32 bp, Homo sapiens
ggaggaggaagaggagaataaggaggagcagg

SEQ ID NO: 12547 - DNA, 32 bp, Homo sapiens
ctgatctcaggtgatccacccacctcagcctc

SEQ ID NO: 12548 - DNA, 32 bp, Homo sapiens
agcatcagtctacaccaacaccatgcggggtt

SEQ ID NO: 12549 - DNA, 32 bp, Homo sapiens
tccctgtcttctctccccattttgtcctttgc

SEQ ID NO: 12550 - DNA, 32 bp, Homo sapiens
aaacgggtggtgtgtctcaggacaaaaggagg

SEQ ID NO: 12551 - DNA, 20 bp, Homo sapiens
gcaggagaggccccccagca

SEQ ID NO: 12552 - DNA, 32 bp, Homo sapiens
tatagaagagccttctgtagaccatatagaaa

SEQ ID NO: 12553 - DNA, 25 bp, Homo sapiens
ccaatgctcaccagccccagagtca

SEQ ID NO: 12554 - DNA, 32 bp, Homo sapiens
ctcgtctctcttctccaggactcctgcactga

SEQ ID NO: 12555 - DNA, 32 bp, Homo sapiens
ctactcgggaggctggggcaggagaatcactt

SEQ ID NO: 12556 - DNA, 32 bp, Homo sapiens
ttctgtcactcaagctgtagtgcagtggtgcc

SEQ ID NO: 12557 - DNA, 32 bp, Homo sapiens
ctttgtttcccaggctggagtgcagtggcacg

SEQ ID NO: 12558 - DNA, 32 bp, Homo sapiens
ctctgtccgccaggctggagtgcagtggcgcg

SEQ ID NO: 12559 - DNA, 32 bp, Homo sapiens
ctactcgggaggctgaggcaggaaaatcactt

SEQ ID NO: 12560 - DNA, 32 bp, Homo sapiens
ctcccaaaagaagaagaaagaacaaatcataa

SEQ ID NO: 12561 - DNA, 32 bp, Homo sapiens
ctggcctcaagcgatcctcccacctcagcctc

SEQ ID NO: 12562 - DNA, 32 bp, Homo sapiens
agggccaggcctgggtctagaattcttgctgc

SEQ ID NO: 12563 - DNA, 20 bp, Homo sapiens
tgtgggaaaagccctggggg

SEQ ID NO: 12564 - DNA, 32 bp, Homo sapiens
tgttgacattttctccccttcctcacttacag

SEQ ID NO: 12565 - DNA, 31 bp, Homo sapiens
ctaccagcagctatccctaggagggagtctc

SEQ ID NO: 12566 - DNA, 24 bp, Homo sapiens
gtcaccgaggctggagtgcaatga

SEQ ID NO: 12567 - DNA, 32 bp, Homo sapiens
aggccttccaagggggtttcagtctggactta

SEQ ID NO: 12568 - DNA, 32 bp, Homo sapiens
tataagaagctttcatattagtgatgtcatct

SEQ ID NO: 12569 - DNA, 32 bp, Homo sapiens
gctttgacacccaggctggagtgcagtagcac

SEQ ID NO: 12570 - DNA, 32 bp, Homo sapiens
gttctgtcacctaggctggaatgcagtggtgc

SEQ ID NO: 12571 - DNA, 32 bp, Homo sapiens
agcacagttctgctgctgtggcttcagctttg

SEQ ID NO: 12572 - DNA, 32 bp, Homo sapiens
ctactcgggaggctcaggcaggagaatcactt

SEQ ID NO: 12573 - DNA, 32 bp, Homo sapiens
atgcctgcttcatgccatgtgctgactgagcc

SEQ ID NO: 12574 - DNA, 32 bp, Homo sapiens
tcttgcccagagctgtgcagtgcagtggctga

SEQ ID NO: 12575 - DNA, 32 bp, Homo sapiens
agtgtgtagagatggctgagtgcaatggctca

SEQ ID NO: 12576 - DNA, 32 bp, Homo sapiens
agaccggctgccgcctgctccccggaaaaggg

SEQ ID NO: 12577 - DNA, 28 bp, Homo sapiens
gatcctaatggtgctgccctatttatac

SEQ ID NO: 12578 - DNA, 32 bp, Homo sapiens
agccacatcctccagtccatctggactagcaa

SEQ ID NO: 12579 - DNA, 32 bp, Homo sapiens
cctccctattaagctcatcccacctcatggat

SEQ ID NO: 12580 - DNA, 32 bp, Homo sapiens
ctccatcgcccaggcctgggatgcagtgatgt

SEQ ID NO: 12581 - DNA, 32 bp, Homo sapiens
actctgtctcccaggctggagtgcagtggagt

SEQ ID NO: 12582 - DNA, 32 bp, Homo sapiens
tcccactcagattgcttcaagagaccaacaga

SEQ ID NO: 12583 - DNA, 32 bp, Homo sapiens
tttctgcactttcgccccatctaccagtcttt

SEQ ID NO: 12584 - DNA, 32 bp, Homo sapiens
agccttgacaaaacgttcctggaactcaagct

SEQ ID NO: 12585 - DNA, 32 bp, Homo sapiens
cacttggagtaacaggcttattccactttcca

SEQ ID NO: 12586 - DNA, 32 bp, Homo sapiens
actctgtcacccaggctgcagtgtagtggtgc

SEQ ID NO: 12587 - DNA, 32 bp, Homo sapiens
agaaagagaaaaagagaaagaaacagaaagaa

SEQ ID NO: 12588 - DNA, 32 bp, Homo sapiens
actctgtcacccatgctggtgtgcagtggcgt

SEQ ID NO: 12589 - DNA, 32 bp, Homo sapiens
ttcattttctttagaatcatttgctactgttt

SEQ ID NO: 12590 - DNA, 32 bp, Homo sapiens
agctgtgaacaaccatgggcatgaagatttct

SEQ ID NO: 12591 - DNA, 32 bp, Homo sapiens
gtctttcacccaggctggagtgctgtggcacg

SEQ ID NO: 12592 - DNA, 32 bp, Homo sapiens
catgtagccctatcgaggagatgatgtagggg

SEQ ID NO: 12593 - DNA, 32 bp, Homo sapiens
gagcccgggaggcagaggttgcagtgagccat

SEQ ID NO: 12594 - DNA, 32 bp, Homo sapiens
gatgagagtgtctatgggaaatggtggttgga

SEQ ID NO: 12595 - DNA, 32 bp, Homo sapiens
ctcatggcagttggctccatctggacctccca

SEQ ID NO: 12596 - DNA, 32 bp, Homo sapiens
ctctgctgcccaggctggagtacagtggcaca

SEQ ID NO: 12597 - DNA, 32 bp, Homo sapiens
agtgctggctgctggcccacagctctgctgga

SEQ ID NO: 12598 - DNA, 32 bp, Homo sapiens
cgggcctcagctgcggccacagctccagatcg

SEQ ID NO: 12599 - DNA, 20 bp, Homo sapiens
agcacaagctgccaggcctg

SEQ ID NO: 12600 - DNA, 32 bp, Homo sapiens
aaaatgtacaccaggctgggtgcggtggctca

SEQ ID NO: 12601 - DNA, 32 bp, Homo sapiens
ctcttgttgcccaggcccgagtgcagtggtgc

SEQ ID NO: 12602 - DNA, 32 bp, Homo sapiens
accctgttggccaggctggagtgcagtaagtg

SEQ ID NO: 12603 - DNA, 32 bp, Homo sapiens
cccagagagcatctggcttcaattttcctttt

SEQ ID NO: 12604 - DNA, 21 bp, Homo sapiens
tcacacctgtaatcctagcac

SEQ ID NO: 12605 - DNA, 32 bp, Homo sapiens
ctctgtctcccaggctgctggagtgcagtggc

SEQ ID NO: 12606 - DNA, 32 bp, Homo sapiens
gaggcagggaggcagggaggcagggaggaacg

SEQ ID NO: 12607 - DNA, 32 bp, Homo sapiens
tagctcggtaatctcatgtaccacaggtaatg

SEQ ID NO: 12608 - DNA, 32 bp, Homo sapiens
ccttcctttccctagtcacaggatcgcagttt

SEQ ID NO: 12609 - DNA, 32 bp, Homo sapiens
ccacagagtgccatccctgagagaccagaccg

SEQ ID NO: 12610 - DNA, 32 bp, Homo sapiens
agaagtgctctgcctgccagtgcagtgcccag

SEQ ID NO: 12611 - DNA, 32 bp, Homo sapiens
aggagatgtccaggctgaaggtggtgatttga

SEQ ID NO: 12612 - DNA, 28 bp, Homo sapiens
tgcccacaagatctagcctcatctggag

SEQ ID NO: 12613 - DNA, 32 bp, Homo sapiens
tgtgacaggaggcagcagaagttgcagagaag

SEQ ID NO: 12614 - DNA, 32 bp, Homo sapiens
ctaagaaacaccatttgatgcaccttagagaa

SEQ ID NO: 12615 - DNA, 32 bp, Homo sapiens
tttctggactgcactgttgtccttgccctcac

SEQ ID NO: 12616 - DNA, 32 bp, Homo sapiens
aaccaggctgggtcaggctcttaatttcacta

SEQ ID NO: 12617 - DNA, 18 bp, Homo sapiens
tcatggttgtccatttga

SEQ ID NO: 12618 - DNA, 32 bp, Homo sapiens
gctctctattggagagaggaagtgactggcct

SEQ ID NO: 12619 - DNA, 23 bp, Homo sapiens
tatgcctgtaatcccagcacttt

SEQ ID NO: 12620 - DNA, 32 bp, Homo sapiens
tttgctcctgttcccctcacagctccagacat

SEQ ID NO: 12621 - DNA, 21 bp, Homo sapiens
ccacaaccaccaccagtgcta

SEQ ID NO: 12622 - DNA, 18 bp, Homo sapiens
ggcaaatgagtgctcttc

SEQ ID NO: 12623 - DNA, 28 bp, Homo sapiens
gtccgcccaagtgccctcctctcagcag

SEQ ID NO: 12624 - DNA, 28 bp, Homo sapiens
taagggccaagtgcagtcctgtcttgat

SEQ ID NO: 12625 - DNA, 32 bp, Homo sapiens
ggcctgcagggacctgagctttgctacccaac

SEQ ID NO: 12626 - DNA, 32 bp, Homo sapiens
agcctcctgagtagctgggactacaggcttgc

SEQ ID NO: 12627 - DNA, 32 bp, Homo sapiens
ctctgccagccaggctggagtgcagtggcatg

SEQ ID NO: 12628 - DNA, 32 bp, Homo sapiens
tcccagtgacgggtctggagtgcgtgggggac

SEQ ID NO: 12629 - DNA, 32 bp, Homo sapiens
gttggaccacacccgtcacagttcacagttcc

SEQ ID NO: 12630 - DNA, 32 bp, Homo sapiens
tccgctggtgcagctttcctttttgcctcttt

SEQ ID NO: 12631 - DNA, 32 bp, Homo sapiens
tccaccaacctgcgcaggcagcacttttggcc

SEQ ID NO: 12632 - DNA, 32 bp, Homo sapiens
gctctgttgccctggctggagttcagtgacat

SEQ ID NO: 12633 - DNA, 32 bp, Homo sapiens
ccggctgcacccagagggagcagtgaggcagg

SEQ ID NO: 12634 - DNA, 32 bp, Homo sapiens
ttctagagatcttttgaaaatttcacacgatt

SEQ ID NO: 12635 - DNA, 23 bp, Homo sapiens
gcttggacatgaagaccctcccc

SEQ ID NO: 12636 - DNA, 32 bp, Homo sapiens
ccttgtcacccaggctgtagtgcggtggcgcg

SEQ ID NO: 12637 - DNA, 32 bp, Homo sapiens
ttttgttgcccaggctggtctccaatttctgg

SEQ ID NO: 12638 - DNA, 28 bp, Homo sapiens
ttggcaggggtggctgcctcatttagag

SEQ ID NO: 12639 - DNA, 32 bp, Homo sapiens
agcctcctgggtagctgggattacaggtgccc

SEQ ID NO: 12640 - DNA, 32 bp, Homo sapiens
agcctcctgagtagctgagattacaggtgccc

SEQ ID NO: 12641 - DNA, 32 bp, Homo sapiens
tagagggcatttctgtcgctgtggaagttgtt

SEQ ID NO: 12642 - DNA, 32 bp, Homo sapiens
acatgggcctgagattttattttagaaaaagg

SEQ ID NO: 12643 - DNA, 32 bp, Homo sapiens
aacttcctgagtagctgggattacaggcgccc

SEQ ID NO: 12644 - DNA, 32 bp, Homo sapiens
cagtttctgaaatgtaagcattacatgactat

SEQ ID NO: 12645 - DNA, 32 bp, Homo sapiens
tttatatcatgggtgaaagtgatcataacatt

SEQ ID NO: 12646 - DNA, 32 bp, Homo sapiens
cccagggtgctgctgccacccgccccagccag

SEQ ID NO: 12647 - DNA, 32 bp, Homo sapiens
aacaggctgctgctgcctccagctgcccacca

SEQ ID NO: 12648 - DNA, 32 bp, Homo sapiens
gctccatcacccaagccagagtgcagtggtga

SEQ ID NO: 12649 - DNA, 21 bp, Homo sapiens
ctgaccaacatggcaaaaccc

SEQ ID NO: 12650 - DNA, 32 bp, Homo sapiens
tggttccaagtctttgctattgtgaataatgc

SEQ ID NO: 12651 - DNA, 32 bp, Homo sapiens
tcgggcgggaggcgggaggcgggaggccgggc

SEQ ID NO: 12652 - DNA, 32 bp, Homo sapiens
tggacctggtgcagctgggaagcttgggactc

SEQ ID NO: 12653 - DNA, 28 bp, Homo sapiens
gatttcccaagtgcccactctcctttgt

SEQ ID NO: 12654 - DNA, 32 bp, Homo sapiens
gaacccggcgggaagaggttgcagtgagccaa

SEQ ID NO: 12655 - DNA, 32 bp, Homo sapiens
ctgggtccaagcaattattgtgcctcagcctc

SEQ ID NO: 12656 - DNA, 32 bp, Homo sapiens
ctggactcaagcagtcctcccacctcagcctc

SEQ ID NO: 12657 - DNA, 32 bp, Homo sapiens
aattataatgtatctgtacagcactttttaca

SEQ ID NO: 12658 - DNA, 32 bp, Homo sapiens
tccttgtatcttctccccttctgagcctgtcc

SEQ ID NO: 12659 - DNA, 32 bp, Homo sapiens
agaggccatgaaggagcaagttttgtatttgt

SEQ ID NO: 12660 - DNA, 32 bp, Homo sapiens
gactatgtagaagtagaaagaaaagaaaaaga

SEQ ID NO: 12661 - DNA, 32 bp, Homo sapiens
ccagcactgcccaggtggctggagcgagtcac

SEQ ID NO: 12662 - DNA, 22 bp, Homo sapiens
caggagagggttccttcagccc

SEQ ID NO: 12663 - DNA, 32 bp, Homo sapiens
ctgctgctgctgctgctgctgcaaactgtact

SEQ ID NO: 12664 - DNA, 32 bp, Homo sapiens
gtctcaaggaggcaggtggcagatgaaaacca

SEQ ID NO: 12665 - DNA, 32 bp, Homo sapiens
tgcagctgcccaggcgctatggcgagtgcggt

SEQ ID NO: 12666 - DNA, 32 bp, Homo sapiens
gctctgtcaccaggctgtacagtgccgtggcc

SEQ ID NO: 12667 - DNA, 32 bp, Homo sapiens
gcaggaagccagctgtcatattcggagggaat

SEQ ID NO: 12668 - DNA, 32 bp, Homo sapiens
tggagagacggaggagaagggcagggttcaga

SEQ ID NO: 12669 - DNA, 32 bp, Homo sapiens
acctccgcctcctgggttcaagagattctcct

SEQ ID NO: 12670 - DNA, 32 bp, Homo sapiens
tgttgtttgcccagcctgggctgcagaaagca

SEQ ID NO: 12671 - DNA, 32 bp, Homo sapiens
cccacctcacccaggtctcagcggcagtgggc

SEQ ID NO: 12672 - DNA, 32 bp, Homo sapiens
tgtcctagaagagggaagaggaaggaaggtgg

SEQ ID NO: 12673 - DNA, 28 bp, Homo sapiens
gagggccttcttgctgcctcacctcatg

SEQ ID NO: 12674 - DNA, 32 bp, Homo sapiens
agccttctgagtagctgggactacagttggtt

SEQ ID NO: 12675 - DNA, 32 bp, Homo sapiens
agcctccggagtagctgggattacaggcacgt

SEQ ID NO: 12676 - DNA, 32 bp, Homo sapiens
agccttctgagtagctgggactacaggcacac

SEQ ID NO: 12677 - DNA, 32 bp, Homo sapiens
tgtctgtctgacgacatctctcctggggtctg

SEQ ID NO: 12678 - DNA, 22 bp, Homo sapiens
gggcggccgaggcaggaagctg

SEQ ID NO: 12679 - DNA, 17 bp, Homo sapiens
gccctctgtcctccagg

SEQ ID NO: 12680 - DNA, 21 bp, Homo sapiens
aggtatgctttcttccagccc

SEQ ID NO: 12681 - DNA, 20 bp, Homo sapiens
cccaggctggagtgcaatga

SEQ ID NO: 12682 - DNA, 32 bp, Homo sapiens
ggttgttggccagacaagtcccagaaactgcc

SEQ ID NO: 12683 - DNA, 32 bp, Homo sapiens
gagcccaggagattgaggctgcagtgagcatg

SEQ ID NO: 12684 - DNA, 32 bp, Homo sapiens
ctcctcgggaggctgaggcaggagaatcgctt

SEQ ID NO: 12685 - DNA, 32 bp, Homo sapiens
agacagggagacagggtctcactgtgttgcct

SEQ ID NO: 12686 - DNA, 32 bp, Homo sapiens
atgttgcccaggctggtctcttaactcctagg

SEQ ID NO: 12687 - DNA, 32 bp, Homo sapiens
gaaagtttttcataaacccccacttgttgctt

SEQ ID NO: 12688 - DNA, 32 bp, Homo sapiens
ctactcgggaggctgaggaaggagaatcgctt

SEQ ID NO: 12689 - DNA, 32 bp, Homo sapiens
ggagggccggaagaggaaagaaaccagagttt

SEQ ID NO: 12690 - DNA, 32 bp, Homo sapiens
caaagaagggtggcgagaagaaaacgggccgt

SEQ ID NO: 12691 - DNA, 32 bp, Homo sapiens
ctgggctcaagcactctgcccacctcagcctc

SEQ ID NO: 12692 - DNA, 32 bp, Homo sapiens
cgcatccttgttctcccctgggtccgtaacat

SEQ ID NO: 12693 - DNA, 32 bp, Homo sapiens
ccacagtttttccctgccttctggaccctcag

SEQ ID NO: 12694 - DNA, 22 bp, Homo sapiens
tcatgcctgtgatcccagcact

SEQ ID NO: 12695 - DNA, 32 bp, Homo sapiens
ggggagttggggttctcataccagcagatttc

SEQ ID NO: 12696 - DNA, 32 bp, Homo sapiens
tgggaagtctcagcagctcttctggctgtgtt

SEQ ID NO: 12697 - DNA, 32 bp, Homo sapiens
tgtgcctttccagcttctagaggctgcctgcg

SEQ ID NO: 12698 - DNA, 32 bp, Homo sapiens
acctctgccttctgggttcaagcaattctctg

SEQ ID NO: 12699 - DNA, 32 bp, Homo sapiens
caatgagggaggcaggcaatatgcagtgaaaa

SEQ ID NO: 12700 - DNA, 32 bp, Homo sapiens
ttctgtctcgcaggccagagtgcagtggtgtg

SEQ ID NO: 12701 - DNA, 32 bp, Homo sapiens
tctacttttacatccccaaaccacctttgtca

SEQ ID NO: 12702 - DNA, 32 bp, Homo sapiens
tcatgtgtgcatcatgtctctttgccaaggga

SEQ ID NO: 12703 - DNA, 32 bp, Homo sapiens
agcctcccaagcagctgggactacatgtatgt

SEQ ID NO: 12704 - DNA, 32 bp, Homo sapiens
ttaattgcttgctctgctaatatttcagcttc

SEQ ID NO: 12705 - DNA, 32 bp, Homo sapiens
gtgggatggagtttcacttgtcacccaggctg

SEQ ID NO: 12706 - DNA, 23 bp, Homo sapiens
tggcacgattttagctcactgca

SEQ ID NO: 12707 - DNA, 32 bp, Homo sapiens
ttcactgtcaccaaggcttagtgcagtgacac

SEQ ID NO: 12708 - DNA, 32 bp, Homo sapiens
actctgtcaccgaggttggagtgcagtggtat

SEQ ID NO: 12709 - DNA, 32 bp, Homo sapiens
gatctgtcgcccaggctggagtgcagtagcgt

SEQ ID NO: 12710 - DNA, 32 bp, Homo sapiens
aaccccctaaattgaagtttagcaatatgaca

SEQ ID NO: 12711 - DNA, 32 bp, Homo sapiens
ggtctctagtagttctggcccacctctttccc

SEQ ID NO: 12712 - DNA, 32 bp, Homo sapiens
ctctgtcatccaggctggagggtagtggcgtg

SEQ ID NO: 12713 - DNA, 32 bp, Homo sapiens
gactggttacattccaatctttgtgcaggaca

SEQ ID NO: 12714 - DNA, 21 bp, Homo sapiens
cagcaacaaactcacaaagta

SEQ ID NO: 12715 - DNA, 31 bp, Homo sapiens
ccaacaaacaagggaactaggaccgacagtg

SEQ ID NO: 12716 - DNA, 32 bp, Homo sapiens
ctgggctcgggtgatcctcccacctcggcctc

SEQ ID NO: 12717 - DNA, 32 bp, Homo sapiens
aaaggcgatcagcttcagtagattcacggcag

SEQ ID NO: 12718 - DNA, 32 bp, Homo sapiens
gcacttttccccaagttcttgtttttattttt

SEQ ID NO: 12719 - DNA, 19 bp, Homo sapiens
gccaccactgccaccacgg

SEQ ID NO: 12720 - DNA, 32 bp, Homo sapiens
actttgtcacccaggctagagtgcagtggcat

SEQ ID NO: 12721 - DNA, 32 bp, Homo sapiens
gctctgttgcccaggctgggtgcagcggtgcg

SEQ ID NO: 12722 - DNA, 32 bp, Homo sapiens
gggcagagaagcggttctgaccacagagctcc

SEQ ID NO: 12723 - DNA, 32 bp, Homo sapiens
gaaccggggaggcagaggttgcagttaagccg

SEQ ID NO: 12724 - DNA, 32 bp, Homo sapiens
gtctgcgggaggcgggttatggcggcggcggc

SEQ ID NO: 12725 - DNA, 32 bp, Homo sapiens
acgctgtcaccaggctggagtgcagtggcgcg

SEQ ID NO: 12726 - DNA, 32 bp, Homo sapiens
aatgccgggaggctgaggcgggagaatcgctt

SEQ ID NO: 12727 - DNA, 32 bp, Homo sapiens
ctacacgggaggctgaggcaggagaatggcat

SEQ ID NO: 12728 - DNA, 32 bp, Homo sapiens
ggcgggcgtcttctccactcctctgccgcgtc

SEQ ID NO: 12729 - DNA, 24 bp, Homo sapiens
tcacacctgtgatcccagcatttt

SEQ ID NO: 12730 - DNA, 24 bp, Homo sapiens
tcgcacctgtaatcccagcatttt

SEQ ID NO: 12731 - DNA, 32 bp, Homo sapiens
tctcctaggttagagaggggtggcctggggtg

SEQ ID NO: 12732 - DNA, 24 bp, Homo sapiens
tggcacagtcatggctcgctgcag

SEQ ID NO: 12733 - DNA, 32 bp, Homo sapiens
gatgatcctcaaggaaatacaacctagggtgc

SEQ ID NO: 12734 - DNA, 32 bp, Homo sapiens
atgcctaggaggttgaggctgcagtgagctgt

SEQ ID NO: 12735 - DNA, 32 bp, Homo sapiens
agcctcctaagtagctgggattacaggcaccc

SEQ ID NO: 12736 - DNA, 32 bp, Homo sapiens
tcttgtcccccagactggagtgcaatggcacg

SEQ ID NO: 12737 - DNA, 32 bp, Homo sapiens
atgcttgggaggtcgaggctgcagtgagtcat

SEQ ID NO: 12738 - DNA, 32 bp, Homo sapiens
ggaaaccctattcaataaatggtgctgggata

SEQ ID NO: 12739 - DNA, 32 bp, Homo sapiens
tagatagccagtcaaccagcagtattagtgct

SEQ ID NO: 12740 - DNA, 32 bp, Homo sapiens
agcctcccaagtagctgggattacaggcacct

SEQ ID NO: 12741 - DNA, 32 bp, Homo sapiens
aacaggggcttagaggaaagttgaagattata

SEQ ID NO: 12742 - DNA, 32 bp, Homo sapiens
gggtgtctctagcctgcagagtgcagtgagtg

SEQ ID NO: 12743 - DNA, 32 bp, Homo sapiens
ctttctcaggaacctttcaagcggccagaacc

SEQ ID NO: 12744 - DNA, 32 bp, Homo sapiens
ctctgtcacccaggctgggaattgcagtggca

SEQ ID NO: 12745 - DNA, 32 bp, Homo sapiens
acctccacctcctgggtttgaggaattgtcct

SEQ ID NO: 12746 - DNA, 28 bp, Homo sapiens
ccctgtccatgtgcagcctcatcagagc

SEQ ID NO: 12747 - DNA, 32 bp, Homo sapiens
ttttgttcttgagaggggtcagtctagaagct

SEQ ID NO: 12748 - DNA, 23 bp, Homo sapiens
tatgcctgtaaccccagcacttt

SEQ ID NO: 12749 - DNA, 32 bp, Homo sapiens
agcctcccgagtagctgggattacaggtgagc

SEQ ID NO: 12750 - DNA, 32 bp, Homo sapiens
tctctgtcacccaggctggagtgcaatggcac

SEQ ID NO: 12751 - DNA, 32 bp, Homo sapiens
tttctgtttgctcagaccctgttttcatgttg

SEQ ID NO: 12752 - DNA, 32 bp, Homo sapiens
gcctgctgcccaggctgtgcagcgcagctgga

SEQ ID NO: 12753 - DNA, 32 bp, Homo sapiens
gctgtgtcaccaggatggagtgcagtggcatg

SEQ ID NO: 12754 - DNA, 32 bp, Homo sapiens
tttgactgtaccattgactgttatggaagttc

SEQ ID NO: 12755 - DNA, 32 bp, Homo sapiens
ctcttgttgcccaggctagagtgcaatggcac

SEQ ID NO: 12756 - DNA, 32 bp, Homo sapiens
agtagaagataaggagaaaagtacgacagaga

SEQ ID NO: 12757 - DNA, 24 bp, Homo sapiens
ctgttggccaggctggagtgcagt

SEQ ID NO: 12758 - DNA, 32 bp, Homo sapiens
cctccaatgaggcagaggttgcagtgagctga

SEQ ID NO: 12759 - DNA, 32 bp, Homo sapiens
gaactcgggaggaagaggttgcagtgagctga

SEQ ID NO: 12760 - DNA, 32 bp, Homo sapiens
aacttgaatgaacactgctcaaactttctgct

SEQ ID NO: 12761 - DNA, 32 bp, Homo sapiens
ttcaaaaggagaggagaaaggaaatgagaatg

SEQ ID NO: 12762 - DNA, 32 bp, Homo sapiens
aaagaaagaaagaaagaaagaaaggaatccta

SEQ ID NO: 12763 - DNA, 32 bp, Homo sapiens
tttaagcatgaatgcgttctggaacacgttag

SEQ ID NO: 12764 - DNA, 32 bp, Homo sapiens
ttgtccccatgcaacaaccaccaccttataca

SEQ ID NO: 12765 - DNA, 32 bp, Homo sapiens
aaaggcctcgggacttcccaccaccttgctcc

SEQ ID NO: 12766 - DNA, 32 bp, Homo sapiens
ctgcttccatttctccccacctcactctcacc

SEQ ID NO: 12767 - DNA, 32 bp, Homo sapiens
ccagcagagactgacagccactgtgaggaacg

SEQ ID NO: 12768 - DNA, 32 bp, Homo sapiens
tttttggtgctgctggtttctccagacctcgc

SEQ ID NO: 12769 - DNA, 32 bp, Homo sapiens
gcctgtgcccatgacatctccctgaaagagga

SEQ ID NO: 12770 - DNA, 32 bp, Homo sapiens
cctccgccttcctgagttcaagcgattctcct

SEQ ID NO: 12771 - DNA, 28 bp, Homo sapiens
gtactctggggtgctgcctgaatccatt

SEQ ID NO: 12772 - DNA, 32 bp, Homo sapiens
cccctgggcacaggctgggatcagggcagtga

SEQ ID NO: 12773 - DNA, 20 bp, Homo sapiens
ggcatttgaacatgctcctc

SEQ ID NO: 12774 - DNA, 32 bp, Homo sapiens
catttttctctcattccatttctgccttaact

SEQ ID NO: 12775 - DNA, 32 bp, Homo sapiens
agaaggaaggaaggagaaagagaaggaaagaa

SEQ ID NO: 12776 - DNA, 32 bp, Homo sapiens
atgtttcttcagcttgagaaattttagaatga

SEQ ID NO: 12777 - DNA, 32 bp, Homo sapiens
caaacgtttaatttgctaaatattttaacaag

SEQ ID NO: 12778 - DNA, 24 bp, Homo sapiens
agctgatgcaactaacaagtactg

SEQ ID NO: 12779 - DNA, 32 bp, Homo sapiens
gactgttgcccaggctggagtgtaatggcgcc

SEQ ID NO: 12780 - DNA, 32 bp, Homo sapiens
gtgagccaacatcacgttttgttagctgtgat

SEQ ID NO: 12781 - DNA, 32 bp, Homo sapiens
ctaaaagattttgatttcctggaatgacaatt

SEQ ID NO: 12782 - DNA, 32 bp, Homo sapiens
agtctcccaagtagctgggattacaggtgtgc

SEQ ID NO: 12783 - DNA, 32 bp, Homo sapiens
ctctgtcacccaggttggagtgcattggtgtg

SEQ ID NO: 12784 - DNA, 32 bp, Homo sapiens
ctctgtcacccaggcttgagtgcagtggtgcg

SEQ ID NO: 12785 - DNA, 32 bp, Homo sapiens
tgtacaggctgagacacagcccagagactgaa

SEQ ID NO: 12786 - DNA, 32 bp, Homo sapiens
gcctcgacctcctgggctcaagcaatcctccc

SEQ ID NO: 12787 - DNA, 28 bp, Homo sapiens
atttatccaagtgctttcatttttccag

SEQ ID NO: 12788 - DNA, 32 bp, Homo sapiens
gagccctggaggtcaaggctgcagtgagccat

SEQ ID NO: 12789 - DNA, 32 bp, Homo sapiens
gaacctgggaggcaaaggttgcagtgagctga

SEQ ID NO: 12790 - DNA, 32 bp, Homo sapiens
ccctgtgctggcacctgctccctgtgctcagt

SEQ ID NO: 12791 - DNA, 32 bp, Homo sapiens
gaacccgggaggcagaggttgcggtgagccga

SEQ ID NO: 12792 - DNA, 32 bp, Homo sapiens
gaacccaggaggcagaggttgcagtgagccga

SEQ ID NO: 12793 - DNA, 32 bp, Homo sapiens
gaacctgggaggcagaggttgcagtgagctaa

SEQ ID NO: 12794 - DNA, 32 bp, Homo sapiens
tctagggaacaacacaattcgattcaccgtat

SEQ ID NO: 12795 - DNA, 25 bp, Homo sapiens
acacaccgcaggaaagccagggcct

SEQ ID NO: 12796 - DNA, 32 bp, Homo sapiens
gaacccgggaggcagaggttgcagtgagccaa

SEQ ID NO: 12797 - DNA, 32 bp, Homo sapiens
tatttcagacaaaatagagaattcttttaaaa

SEQ ID NO: 12798 - DNA, 32 bp, Homo sapiens
gggaaaagggaaggcgtgctgtggaaataaaa

SEQ ID NO: 12799 - DNA, 32 bp, Homo sapiens
ctgtcacccccaggccagagtgcagtggtgcg

SEQ ID NO: 12800 - DNA, 32 bp, Homo sapiens
gataaccaaattctgtcactcaagacacagac

SEQ ID NO: 12801 - DNA, 32 bp, Homo sapiens
tggggcccggtgtcactcacagctccatctct

SEQ ID NO: 12802 - DNA, 32 bp, Homo sapiens
ttagccacacttctcccttcaggggcttcgga

SEQ ID NO: 12803 - DNA, 32 bp, Homo sapiens
tctgttgtccaaggctggagtgtagtagtgct

SEQ ID NO: 12804 - DNA, 32 bp, Homo sapiens
ctctgtcgccaggactggagtgcagtgacacg

SEQ ID NO: 12805 - DNA, 32 bp, Homo sapiens
cactctttcccaggctgcagtacagtgacaca

SEQ ID NO: 12806 - DNA, 32 bp, Homo sapiens
gttctcttgcccaggctggagtgcagtggcac

SEQ ID NO: 12807 - DNA, 32 bp, Homo sapiens
ctgttgttgcccaggctggagtgcaatggcgc

SEQ ID NO: 12808 - DNA, 32 bp, Homo sapiens
taccagccctgagacagaccccaggataaggg

SEQ ID NO: 12809 - DNA, 21 bp, Homo sapiens
acaggcgcccaccaccacagc

SEQ ID NO: 12810 - DNA, 32 bp, Homo sapiens
gccgccattgcagcttgttttcacttgctttt

SEQ ID NO: 12811 - DNA, 32 bp, Homo sapiens
ccaggatcaagcaattctgactcagcctccca

SEQ ID NO: 12812 - DNA, 32 bp, Homo sapiens
agaacaggagatggagaaagcaagtggaagac

SEQ ID NO: 12813 - DNA, 32 bp, Homo sapiens
gagaggtgagcagcaggggagcgggcacagtc

SEQ ID NO: 12814 - DNA, 21 bp, Homo sapiens
acaggcgcccgccaccacggc

SEQ ID NO: 12815 - DNA, 32 bp, Homo sapiens
gttatcccaagtgctcttattctggtgagaag

SEQ ID NO: 12816 - DNA, 32 bp, Homo sapiens
gctctgtcacccaggctagagtgcagtagcac

SEQ ID NO: 12817 - DNA, 32 bp, Homo sapiens
tgctaggggttaggcttttgagcttgaacgcc

SEQ ID NO: 12818 - DNA, 32 bp, Homo sapiens
cctcaatcaagtgcctttaaatagagctgcac

SEQ ID NO: 12819 - DNA, 32 bp, Homo sapiens
cagggttcgggcaattctcctgccttagcctc

SEQ ID NO: 12820 - DNA, 32 bp, Homo sapiens
atttcatctagcaattctctttgacttagtcg

SEQ ID NO: 12821 - DNA, 32 bp, Homo sapiens
cctgtccactgcactcctcccacctcattttt

SEQ ID NO: 12822 - DNA, 32 bp, Homo sapiens
tctgacagaagaggagcaggagaaacaaatcg

SEQ ID NO: 12823 - DNA, 32 bp, Homo sapiens
gctagagtgaacttgggccactgtgaagagaa

SEQ ID NO: 12824 - DNA, 32 bp, Homo sapiens
cgctcttttctctcctctcttctgcctctttt

SEQ ID NO: 12825 - DNA, 32 bp, Homo sapiens
gaaaatcatatcctgaatcatactgagactga

SEQ ID NO: 12826 - DNA, 32 bp, Homo sapiens
ctctgtcaccgaggctggagtgcagtggcgcg

SEQ ID NO: 12827 - DNA, 32 bp, Homo sapiens
acagagtttggatagtaaagaaaacaacaata

SEQ ID NO: 12828 - DNA, 32 bp, Homo sapiens
tgtgttttaagtgcccagtgaacacagttcca

SEQ ID NO: 12829 - DNA, 32 bp, Homo sapiens
actgtgttgcccaggctggagtgcaaatggct

SEQ ID NO: 12830 - DNA, 32 bp, Homo sapiens
gaaggagcgttcgaggaatggatgaggtcggg

SEQ ID NO: 12831 - DNA, 32 bp, Homo sapiens
gaatccgggaagcagaggttgtagtgagccaa

SEQ ID NO: 12832 - DNA, 30 bp, Homo sapiens
aagaaatggaggaagcaaagaaaatgatat

SEQ ID NO: 12833 - DNA, 32 bp, Homo sapiens
gccttcctgagtagctgggattacaggcagcc

SEQ ID NO: 12834 - DNA, 32 bp, Homo sapiens
tgcgtttgtcccaggctcgggggctcagtggg

SEQ ID NO: 12835 - DNA, 24 bp, Homo sapiens
tcacgcctgtaatcctagcccttt

SEQ ID NO: 12836 - DNA, 24 bp, Homo sapiens
tcatacctttaatcccagcacttt

SEQ ID NO: 12837 - DNA, 32 bp, Homo sapiens
acccagcaaaaatgaagaggaaaacaaacagg

SEQ ID NO: 12838 - DNA, 23 bp, Homo sapiens
tggcaccatcttggctcactgca

SEQ ID NO: 12839 - DNA, 32 bp, Homo sapiens
ggagaggtcaaaacatccacctaccttcaaaa

SEQ ID NO: 12840 - DNA, 32 bp, Homo sapiens
caccatttctctccaggctttctgcctccgag

SEQ ID NO: 12841 - DNA, 32 bp, Homo sapiens
ggcaggccatcaggctgggggctgtgctatgt

SEQ ID NO: 12842 - DNA, 32 bp, Homo sapiens
tgtcacttagttctgtggttccagcagatctc

SEQ ID NO: 12843 - DNA, 32 bp, Homo sapiens
gaagaggagccagccaggtcttcattcaaacc

SEQ ID NO: 12844 - DNA, 23 bp, Homo sapiens
ctgcactcaggctggagtgcagt

SEQ ID NO: 12845 - DNA, 32 bp, Homo sapiens
accacgaggccccgtccggtggaacacgccat

SEQ ID NO: 12846 - DNA, 32 bp, Homo sapiens
ccaggttcaagcaattctcctgccttagcctc

SEQ ID NO: 12847 - DNA, 32 bp, Homo sapiens
ctaggttcaagcaattctcctgcctcagcctc

SEQ ID NO: 12848 - DNA, 32 bp, Homo sapiens
gtgcttaagaatgggattcccacctcagttta

SEQ ID NO: 12849 - DNA, 16 bp, Homo sapiens
aggagaattgcctgag

SEQ ID NO: 12850 - DNA, 32 bp, Homo sapiens
ctgggttcaagcaattctgtggcttcagcctc

SEQ ID NO: 12851 - DNA, 32 bp, Homo sapiens
ctgggttcaaacaattctcctgcctcagcctc

SEQ ID NO: 12852 - DNA, 32 bp, Homo sapiens
ggctcctctgggagtttctcccagagaaacca

SEQ ID NO: 12853 - DNA, 32 bp, Homo sapiens
gccatcactcaaggacttctctccaggccccg

SEQ ID NO: 12854 - DNA, 32 bp, Homo sapiens
aaagcccccaaaacaaaacaaaccttaattga

SEQ ID NO: 12855 - DNA, 32 bp, Homo sapiens
ggaagaggaagaagaggtagaaaacatatttt

SEQ ID NO: 12856 - DNA, 24 bp, Homo sapiens
aacaaagacccacactactggaca

SEQ ID NO: 12857 - DNA, 32 bp, Homo sapiens
ttgtcagccctctcatactatgaacatatggg

SEQ ID NO: 12858 - DNA, 32 bp, Homo sapiens
ggccacccaaagtgttgggattataggcatga

SEQ ID NO: 12859 - DNA, 27 bp, Homo sapiens
agatgcccaacaacagcactgctctgt

SEQ ID NO: 12860 - DNA, 32 bp, Homo sapiens
acctccgcctccctggttcaagcaattctcct

SEQ ID NO: 12861 - DNA, 32 bp, Homo sapiens
cctgccgtctatccacccatctgttcctcgtc

SEQ ID NO: 12862 - DNA, 32 bp, Homo sapiens
cagaagaggagtctgaggataactaaacttca

SEQ ID NO: 12863 - DNA, 32 bp, Homo sapiens
ggaggaggaagaggaggaggaagaggacttct

SEQ ID NO: 12864 - DNA, 23 bp, Homo sapiens
gtcacccaggctagagtgcagtg

SEQ ID NO: 12865 - DNA, 23 bp, Homo sapiens
gtcgcccaggctggagtgcgatg

SEQ ID NO: 12866 - DNA, 23 bp, Homo sapiens
gtcacccaggctggagtgcaatg

SEQ ID NO: 12867 - DNA, 32 bp, Homo sapiens
ttttgttgcccaggctggagttcagtggcgtg

SEQ ID NO: 12868 - DNA, 32 bp, Homo sapiens
ctctgtcacccaggctggagtgcagtggtgac

SEQ ID NO: 12869 - DNA, 32 bp, Homo sapiens
ctgtaggccagccttagccactgtggagccct

SEQ ID NO: 12870 - DNA, 32 bp, Homo sapiens
gtcaccatccaccctcgtaacaacagtctccc

SEQ ID NO: 12871 - DNA, 32 bp, Homo sapiens
agagacaggttagagggaaagaggcttgggaa

SEQ ID NO: 12872 - DNA, 32 bp, Homo sapiens
tgctctgtcgccaggctggagtgcaatggcgt

SEQ ID NO: 12873 - DNA, 28 bp, Homo sapiens
ccacccccaagtgccgacttgtttctcc

SEQ ID NO: 12874 - DNA, 17 bp, Homo sapiens
cccctaagctccaggtg

SEQ ID NO: 12875 - DNA, 32 bp, Homo sapiens
cagacttgcccagcagcatgagtagtgaagtg

SEQ ID NO: 12876 - DNA, 32 bp, Homo sapiens
tgtatgttttgtgctgaactggcagctatccc

SEQ ID NO: 12877 - DNA, 20 bp, Homo sapiens
ggaggcagcaggagcagtga

SEQ ID NO: 12878 - DNA, 32 bp, Homo sapiens
ccagactgtcttcaaattcttctgcctagcct

SEQ ID NO: 12879 - DNA, 32 bp, Homo sapiens
ccccaccatcttctccaccaaccccaacctcc

SEQ ID NO: 12880 - DNA, 32 bp, Homo sapiens
gagcgttacatcctgatatccttccaggctgc

SEQ ID NO: 12881 - DNA, 32 bp, Homo sapiens
accttctgtttccatgtcacagctccaccata

SEQ ID NO: 12882 - DNA, 32 bp, Homo sapiens
tggctccgcccttgggaacaggcacggaccac

SEQ ID NO: 12883 - DNA, 32 bp, Homo sapiens
acctctgcctcctgggttcaagcaattttcct

SEQ ID NO: 12884 - DNA, 32 bp, Homo sapiens
aaccaaagcggtgcatggcaatgtgatagggg

SEQ ID NO: 12885 - DNA, 32 bp, Homo sapiens
cacttgaggttaggagtttgagatcagcccgg

SEQ ID NO: 12886 - DNA, 32 bp, Homo sapiens
gaatgtgggaggcggaggttgcagtgagtcag

SEQ ID NO: 12887 - DNA, 32 bp, Homo sapiens
aaagaaagaaagaaagaaagaaagaaaatatc

SEQ ID NO: 12888 - DNA, 32 bp, Homo sapiens
aaaatgggtaagcatagccactggtgggatat

SEQ ID NO: 12889 - DNA, 22 bp, Homo sapiens
tcatgcctgtaatcccagcact

SEQ ID NO: 12890 - DNA, 32 bp, Homo sapiens
cagagacccagtgccctcaacagtaagacttt

SEQ ID NO: 12891 - DNA, 32 bp, Homo sapiens
cggccctgggagcagaggtggagcgaccccat

SEQ ID NO: 12892 - DNA, 32 bp, Homo sapiens
catgaaggaataggcaggacttaacttggggt

SEQ ID NO: 12893 - DNA, 17 bp, Homo sapiens
gcaaaaacagaagcaaa

SEQ ID NO: 12894 - DNA, 32 bp, Homo sapiens
agcctcatgagtagctgggattacaggtatgt

SEQ ID NO: 12895 - DNA, 32 bp, Homo sapiens
gggatatttaaggtagcttcagctagctttta

SEQ ID NO: 12896 - DNA, 32 bp, Homo sapiens
ccgtgttcaagcaattctcctacctcagccta

SEQ ID NO: 12897 - DNA, 32 bp, Homo sapiens
tgctgctacctgctttccagagcctttcatca

SEQ ID NO: 12898 - DNA, 32 bp, Homo sapiens
agggtcccaagtgctggtcccaacctgaagct

SEQ ID NO: 12899 - DNA, 32 bp, Homo sapiens
tcactgccattttgtgaggtgctgctgtctct

SEQ ID NO: 12900 - DNA, 28 bp, Homo sapiens
atgcatctcccaagtgcctcatgcttgc

SEQ ID NO: 12901 - DNA, 32 bp, Homo sapiens
aggggacggctctggttccccacgctgcccct

SEQ ID NO: 12902 - DNA, 32 bp, Homo sapiens
ctatggaggcctggcgggctagcttgggtgtc

SEQ ID NO: 12903 - DNA, 32 bp, Homo sapiens
taaatatcaggaaagacgctgtgggaaaatag

SEQ ID NO: 12904 - DNA, 21 bp, Homo sapiens
gggcggccacagattacactg

SEQ ID NO: 12905 - DNA, 32 bp, Homo sapiens
ttaatgttaagcaattccaccacacttctgaa

SEQ ID NO: 12906 - DNA, 32 bp, Homo sapiens
cagggctcaggtgatcctcccacctcagccac

SEQ ID NO: 12907 - DNA, 32 bp, Homo sapiens
aaaactaaaaaccaaacacaccaccttccttg

SEQ ID NO: 12908 - DNA, 32 bp, Homo sapiens
tactctacagcagcttcactgcctgaaaatga

SEQ ID NO: 12909 - DNA, 23 bp, Homo sapiens
tgtggggaggagagagatgcaga

SEQ ID NO: 12910 - DNA, 22 bp, Homo sapiens
ctcaccgcctcctcttcgggca

SEQ ID NO: 12911 - DNA, 25 bp, Homo sapiens
acaggcacccgccaccacacccagc

SEQ ID NO: 12912 - DNA, 32 bp, Homo sapiens
ggtgcaagggcctctttcaaaatgaacccact

SEQ ID NO: 12913 - DNA, 23 bp, Homo sapiens
tccttgcactagctacatcctca

SEQ ID NO: 12914 - DNA, 32 bp, Homo sapiens
tgcagaaatttcctcagccactggagggattt

SEQ ID NO: 12915 - DNA, 32 bp, Homo sapiens
tgccattggaacttggattactgtgaacattg

SEQ ID NO: 12916 - DNA, 32 bp, Homo sapiens
tggctctgcccaggtggggtggggtggcccag

SEQ ID NO: 12917 - DNA, 32 bp, Homo sapiens
ggtccccatgtccagccttgtgcagtgagttc

SEQ ID NO: 12918 - DNA, 32 bp, Homo sapiens
ctctgtcacccaggctggaatccagtggcact

SEQ ID NO: 12919 - DNA, 28 bp, Homo sapiens
aacatcccaagtgtatgtctcttccctg

SEQ ID NO: 12920 - DNA, 32 bp, Homo sapiens
ctgctcgggaggcagaggcaggagaatggcgt

SEQ ID NO: 12921 - DNA, 32 bp, Homo sapiens
caatctgggaggtggaagttgcagtgagccga

SEQ ID NO: 12922 - DNA, 32 bp, Homo sapiens
gaacccgggaggcatagcttgcagtgagccga

SEQ ID NO: 12923 - DNA, 32 bp, Homo sapiens
taagcgtctcttacagcagagagaccagacca

SEQ ID NO: 12924 - DNA, 32 bp, Homo sapiens
agcctcccgagtggctgggattagcggcatgc

SEQ ID NO: 12925 - DNA, 32 bp, Homo sapiens
gctctgtcaccaaggctggagtgcaggggcac

SEQ ID NO: 12926 - DNA, 32 bp, Homo sapiens
gaaattttatctgaattccgtaatgaatatac

SEQ ID NO: 12927 - DNA, 32 bp, Homo sapiens
acagagactgcaggggtccactgtgagaggtg

SEQ ID NO: 12928 - DNA, 32 bp, Homo sapiens
taacatggtgacttgctcacagcctcactgga

SEQ ID NO: 12929 - DNA, 32 bp, Homo sapiens
gaccccaggaggtggacattgcagtgagccga

SEQ ID NO: 12930 - DNA, 32 bp, Homo sapiens
cagggagacagacagaggttgcagtgagccga

SEQ ID NO: 12931 - DNA, 32 bp, Homo sapiens
aacccaccaagtgcctgtgtgcagcctcctgt

SEQ ID NO: 12932 - DNA, 32 bp, Homo sapiens
tggtagcctagagtcctggggagcttctgtcc

SEQ ID NO: 12933 - DNA, 32 bp, Homo sapiens
gaaccctgggagcggagattgcagtgagctga

SEQ ID NO: 12934 - DNA, 32 bp, Homo sapiens
aacacctctgcagtgcctgcttcttacctggc

SEQ ID NO: 12935 - DNA, 32 bp, Homo sapiens
tctttcaagattcattctccctgaatcttacc

SEQ ID NO: 12936 - DNA, 32 bp, Homo sapiens
agatcactgcctgggaggcttggcttagtact

SEQ ID NO: 12937 - DNA, 32 bp, Homo sapiens
agattagtaggaggagaagtgaatgtaaattt

SEQ ID NO: 12938 - DNA, 17 bp, Homo sapiens
aaggggcccaaccctgc

SEQ ID NO: 12939 - DNA, 32 bp, Homo sapiens
ttataatcctcaattatgaaccaccttgttta

SEQ ID NO: 12940 - DNA, 32 bp, Homo sapiens
ttaatgcacatccttatctcattgctggcttc

SEQ ID NO: 12941 - DNA, 32 bp, Homo sapiens
gtgggctccagggactggagtgtaatgctcgg

SEQ ID NO: 12942 - DNA, 32 bp, Homo sapiens
ttgagatgcagagtctagagtgcagtggtgca

SEQ ID NO: 12943 - DNA, 32 bp, Homo sapiens
gagctgggctaacaggctgacacttcggcagg

SEQ ID NO: 12944 - DNA, 32 bp, Homo sapiens
tcagcggccaaggggagtgacaacagccagac

SEQ ID NO: 12945 - DNA, 23 bp, Homo sapiens
ttgtgtccaggctggagtgcagt

SEQ ID NO: 12946 - DNA, 32 bp, Homo sapiens
actgccatcttcaagctgggtgcagtggctca

SEQ ID NO: 12947 - DNA, 32 bp, Homo sapiens
acaatttgacatgatggatggtgtggctggga

SEQ ID NO: 12948 - DNA, 32 bp, Homo sapiens
acggcctctccttcatcacaggccggggattc

SEQ ID NO: 12949 - DNA, 23 bp, Homo sapiens
gtcgcccaagctggagtgcagtg

SEQ ID NO: 12950 - DNA, 18 bp, Homo sapiens
catgcctgtaatcccagc

SEQ ID NO: 12951 - DNA, 32 bp, Homo sapiens
ctctattggccaggctggagtgtagtggcacc

SEQ ID NO: 12952 - DNA, 32 bp, Homo sapiens
gggaaggtcagaggagaaggcaggcagggccc

SEQ ID NO: 12953 - DNA, 32 bp, Homo sapiens
gcaataccattcaggacacaggcatgggcaag

SEQ ID NO: 12954 - DNA, 32 bp, Homo sapiens
ctactcgggaggctgacgcaggagaatcactt

SEQ ID NO: 12955 - DNA, 27 bp, Homo sapiens
ccatgtccaagtgctgtgctcagtctc

SEQ ID NO: 12956 - DNA, 32 bp, Homo sapiens
accaggtcacccagctatgctgcaaagtgggt

SEQ ID NO: 12957 - DNA, 32 bp, Homo sapiens
accctgtcgcccaggctggagtgcaatgccgt

SEQ ID NO: 12958 - DNA, 32 bp, Homo sapiens
ggattgttcctagtgaggaaggtcttgtccca

SEQ ID NO: 12959 - DNA, 32 bp, Homo sapiens
accctggcgggccctctccccacctcacctct

SEQ ID NO: 12960 - DNA, 32 bp, Homo sapiens
aaaggatcaagcaatctcttgccacctcccag

SEQ ID NO: 12961 - DNA, 32 bp, Homo sapiens
ggctcacacctgcaatcccagcactttggaag

SEQ ID NO: 12962 - DNA, 32 bp, Homo sapiens
acgcccgccctctcgccttcgccgaaccaaag

SEQ ID NO: 12963 - DNA, 32 bp, Homo sapiens
aaggagcccctctctgcttcctgttgggcacc

SEQ ID NO: 12964 - DNA, 32 bp, Homo sapiens
ccctggcattggagagaagcccactgtggtca

SEQ ID NO: 12965 - DNA, 32 bp, Homo sapiens
cggcctggcccaggctgccgctgtacggtgag

SEQ ID NO: 12966 - DNA, 32 bp, Homo sapiens
ctcttcagtggaggagaacaagaaataaacaa

SEQ ID NO: 12967 - DNA, 32 bp, Homo sapiens
ctggaggggctgctgctcctcagttgcatttc

SEQ ID NO: 12968 - DNA, 32 bp, Homo sapiens
tgcttgtcatccaagctggagtacagtgccat

SEQ ID NO: 12969 - DNA, 32 bp, Homo sapiens
gaagccgggaggctcagcctgaaagtggctcc

SEQ ID NO: 12970 - DNA, 32 bp, Homo sapiens
caggtcacttccttttcactcagtttaaattg

SEQ ID NO: 12971 - DNA, 32 bp, Homo sapiens
agcctccctagtagctgggattacaggcatgt

SEQ ID NO: 12972 - DNA, 32 bp, Homo sapiens
actctgttgcccgggctggagtgcagcggcgt

SEQ ID NO: 12973 - DNA, 32 bp, Homo sapiens
gctctgtcactcaggctggaatgcagtggcgc

SEQ ID NO: 12974 - DNA, 31 bp, Homo sapiens
ggaggaacatagcaaagtaggagggacagag

SEQ ID NO: 12975 - DNA, 32 bp, Homo sapiens
actctgtcacccaggctggagtgcagcagttg

SEQ ID NO: 12976 - DNA, 19 bp, Homo sapiens
gtccaggctggagtgcaat

SEQ ID NO: 12977 - DNA, 32 bp, Homo sapiens
tccttggcagaactcagttaaatctttgaaga

SEQ ID NO: 12978 - DNA, 32 bp, Homo sapiens
aactgatattactcaatttcagtctggacact

SEQ ID NO: 12979 - DNA, 32 bp, Homo sapiens
ttgagctcaggagttcgagaccaccttgggcc

SEQ ID NO: 12980 - DNA, 32 bp, Homo sapiens
ttactcctttgagaattctttaacaatattta

SEQ ID NO: 12981 - DNA, 32 bp, Homo sapiens
cattactgcccaggtaaggagtgctagaatca

SEQ ID NO: 12982 - DNA, 32 bp, Homo sapiens
gaagctgatgcaggggaaagaaattaacaacc

SEQ ID NO: 12983 - DNA, 28 bp, Homo sapiens
agctccccaagtgattctacgttcccca

SEQ ID NO: 12984 - DNA, 32 bp, Homo sapiens
tgaggcatgaggattgcttgagcttggaaggt

SEQ ID NO: 12985 - DNA, 32 bp, Homo sapiens
atgtccatgagggagaggttgctgagaagtac

SEQ ID NO: 12986 - DNA, 32 bp, Homo sapiens
tcctccgcctcccgggttcaagtgattctcat

SEQ ID NO: 12987 - DNA, 32 bp, Homo sapiens
ccgtcggtgctgctgctcctgcagctgccttt

SEQ ID NO: 12988 - DNA, 32 bp, Homo sapiens
cctgatccaaagagaccaagtcactgtactgg

SEQ ID NO: 12989 - DNA, 32 bp, Homo sapiens
tatgcggtgacggcggggtgtggtggcctgtg

SEQ ID NO: 12990 - DNA, 32 bp, Homo sapiens
tttcaaaacatcctggagatttgtactaaggc

SEQ ID NO: 12991 - DNA, 32 bp, Homo sapiens
ccatttttgggtgttttctaccacagattgat

SEQ ID NO: 12992 - DNA, 32 bp, Homo sapiens
agtaaccaaatctgtgaaaatattcacatgag

SEQ ID NO: 12993 - DNA, 32 bp, Homo sapiens
ggcggaggttgcagtgagttgcagtcacaccc

SEQ ID NO: 12994 - DNA, 32 bp, Homo sapiens
ggcctcccaagttgctgggattactgacacaa

SEQ ID NO: 12995 - DNA, 32 bp, Homo sapiens
gaccatcaagtgggaagatgtgatttgtcttg

SEQ ID NO: 12996 - DNA, 32 bp, Homo sapiens
tgcccagcctccaactccagctgagtcctggg

SEQ ID NO: 12997 - DNA, 32 bp, Homo sapiens
attgttagagcctctgactggggttcaccata

SEQ ID NO: 12998 - DNA, 18 bp, Homo sapiens
caggcttttgttgctgaa

SEQ ID NO: 12999 - DNA, 32 bp, Homo sapiens
aaacttacttgggattattagcactttcaaac

SEQ ID NO: 13000 - DNA, 32 bp, Homo sapiens
aaagacaaggcccctggcagtgcagtgttgga

SEQ ID NO: 13001 - DNA, 32 bp, Homo sapiens
ggttggtgtacttggcttaagtacttcatgct

SEQ ID NO: 13002 - DNA, 32 bp, Homo sapiens
aggtgtcatccctttgtgtcagagacagaccc

SEQ ID NO: 13003 - DNA, 32 bp, Homo sapiens
gctctgtcacccaggctggagtgcaatgacgc

SEQ ID NO: 13004 - DNA, 32 bp, Homo sapiens
tgggaggtagtgttataactggcactttaatt

SEQ ID NO: 13005 - DNA, 32 bp, Homo sapiens
cagttccgatgccccttcctggacaccgtccc

SEQ ID NO: 13006 - DNA, 32 bp, Homo sapiens
ctaagtaaactttgttgtcaagcaatttgtcc

SEQ ID NO: 13007 - DNA, 32 bp, Homo sapiens
ctgagctcaggcagtctacccacctcagcctc

SEQ ID NO: 13008 - DNA, 32 bp, Homo sapiens
aatatccctactgacagtaactacctgtcaca

SEQ ID NO: 13009 - DNA, 32 bp, Homo sapiens
tagaaaaatgttctttaaaggcatctacacaa

SEQ ID NO: 13010 - DNA, 19 bp, Homo sapiens
cagggaagctctttaggcc

SEQ ID NO: 13011 - DNA, 32 bp, Homo sapiens
caggattctgcagctccttttgtgccaagccc

SEQ ID NO: 13012 - DNA, 25 bp, Homo sapiens
tcatacctgtaaatcccagcacttt

SEQ ID NO: 13013 - DNA, 32 bp, Homo sapiens
gaaaatgctcatctgtcatcttcatggatgaa

SEQ ID NO: 13014 - DNA, 32 bp, Homo sapiens
ccatcccaggcagagcaccactgtgatttgtt

SEQ ID NO: 13015 - DNA, 32 bp, Homo sapiens
gatgtagcacaatttccacactgtgaaggcag

SEQ ID NO: 13016 - DNA, 32 bp, Homo sapiens
tgaattccaagtgctccattggatcagcttcc

SEQ ID NO: 13017 - DNA, 32 bp, Homo sapiens
gcctccaactcctgggctcaagcaatccacct

SEQ ID NO: 13018 - DNA, 32 bp, Homo sapiens
acctccgcctcccaggttcaagcagttctcct

SEQ ID NO: 13019 - DNA, 28 bp, Homo sapiens
ctgaccaggtgtagtgcctcatgcctgt

SEQ ID NO: 13020 - DNA, 32 bp, Homo sapiens
gctatttccatcctccccataggggctctctc

SEQ ID NO: 13021 - DNA, 32 bp, Homo sapiens
tggggtcagagtggttctcccagggccttcaa

SEQ ID NO: 13022 - DNA, 32 bp, Homo sapiens
gaattatcacccagacatgtgcagatgaaatg

SEQ ID NO: 13023 - DNA, 18 bp, Homo sapiens
tgtggggaaggtatgggg

SEQ ID NO: 13024 - DNA, 32 bp, Homo sapiens
acatacgttgttctcccctctctggatcaagg

SEQ ID NO: 13025 - DNA, 32 bp, Homo sapiens
tcacttcatcttctcagctcccatttctactc

SEQ ID NO: 13026 - DNA, 32 bp, Homo sapiens
caggatagttgcactgagcactgtgaggcccc

SEQ ID NO: 13027 - DNA, 25 bp, Homo sapiens
acaagcggctgccaccacacctggc

SEQ ID NO: 13028 - DNA, 32 bp, Homo sapiens
acagtggtggctgggctcacagctccatccat

SEQ ID NO: 13029 - DNA, 32 bp, Homo sapiens
ttttgttgcccaggctggagtgcaatggcgcg

SEQ ID NO: 13030 - DNA, 32 bp, Homo sapiens
cttcgttgcccagtttccgctcagtggtcgcg

SEQ ID NO: 13031 - DNA, 32 bp, Homo sapiens
ttaatgacagaacttggctaatggaattcaca

SEQ ID NO: 13032 - DNA, 32 bp, Homo sapiens
acaaagacaacattgttcctggaacgccctct

SEQ ID NO: 13033 - DNA, 28 bp, Homo sapiens
ccaggccagagtgctgccagtcctctgc

SEQ ID NO: 13034 - DNA, 28 bp, Homo sapiens
tcagcactgagtactgcctcatctgctg

SEQ ID NO: 13035 - DNA, 32 bp, Homo sapiens
cagctcagctgtcatctcagtgaccagttttt

SEQ ID NO: 13036 - DNA, 32 bp, Homo sapiens
ccaatgcatcttctaccctgctacctcagtga

SEQ ID NO: 13037 - DNA, 32 bp, Homo sapiens
actgtcttgcccaggctggagtgcagtggcct

SEQ ID NO: 13038 - DNA, 32 bp, Homo sapiens
taatttaacaaatctgaaaatatgtcaaatta

SEQ ID NO: 13039 - DNA, 32 bp, Homo sapiens
aaagaaggtatctcaggccaggcacagtggcc

SEQ ID NO: 13040 - DNA, 18 bp, Homo sapiens
ggaggcagccccctgtga

SEQ ID NO: 13041 - DNA, 32 bp, Homo sapiens
gttgtcacttaagtttggagtgcagtggcatg

SEQ ID NO: 13042 - DNA, 32 bp, Homo sapiens
tgttgtcacccaggctggagtgcagtggtgtg

SEQ ID NO: 13043 - DNA, 32 bp, Homo sapiens
tccagctcagttctgtgtacaaaccatggagg

SEQ ID NO: 13044 - DNA, 32 bp, Homo sapiens
acctctacctcctgggttcaagtgattctctt

SEQ ID NO: 13045 - DNA, 32 bp, Homo sapiens
acctccacctcccgggttcaagtgattcatgt

SEQ ID NO: 13046 - DNA, 32 bp, Homo sapiens
acctctacctcctgggttcaagcgattctcct

SEQ ID NO: 13047 - DNA, 32 bp, Homo sapiens
ctggcctcaagcaatcctcccacctcggcctc

SEQ ID NO: 13048 - DNA, 32 bp, Homo sapiens
gctttgtcacgcaggctagagtgcagtggcgc

SEQ ID NO: 13049 - DNA, 32 bp, Homo sapiens
atttgagggaggcagaagtctgcagttgaaga

SEQ ID NO: 13050 - DNA, 32 bp, Homo sapiens
tcccacactgcagctttatctttaggcttatg

SEQ ID NO: 13051 - DNA, 32 bp, Homo sapiens
acacattgcaggtcagcttcttcctctgccca

SEQ ID NO: 13052 - DNA, 32 bp, Homo sapiens
cagggttcaagcaattctcctgcctcagtctc

SEQ ID NO: 13053 - DNA, 32 bp, Homo sapiens
tctctgtagccaggctggagggcaattgtaca

SEQ ID NO: 13054 - DNA, 32 bp, Homo sapiens
gcgaccaacacagaggagagaaaacaaaaata

SEQ ID NO: 13055 - DNA, 32 bp, Homo sapiens
agacacatcatttatacacaggcacaggggcc

SEQ ID NO: 13056 - DNA, 32 bp, Homo sapiens
acctccacctcctgggttcaagcgattctgct

SEQ ID NO: 13057 - DNA, 32 bp, Homo sapiens
atggcctgcaccctcctgcagtgcagttgctg

SEQ ID NO: 13058 - DNA, 32 bp, Homo sapiens
gaacccgggaggcagagattgcagtaagctga

SEQ ID NO: 13059 - DNA, 32 bp, Homo sapiens
gaacctaggaggcagaggttgcagtgagccaa

SEQ ID NO: 13060 - DNA, 32 bp, Homo sapiens
gaacctgggaggcagaggttgtggtgagctaa

SEQ ID NO: 13061 - DNA, 32 bp, Homo sapiens
gaacctgggaggcagaggttgtagtgagctga

SEQ ID NO: 13062 - DNA, 32 bp, Homo sapiens
gaacccaggaggcagaggttgtagtgagccaa

SEQ ID NO: 13063 - DNA, 32 bp, Homo sapiens
gaacccaggaggcagaggttgcagtgagctaa

SEQ ID NO: 13064 - DNA, 32 bp, Homo sapiens
ccactcttgcccaggctggagcgcaagtggcg

SEQ ID NO: 13065 - DNA, 32 bp, Homo sapiens
gaacccgggaggcagaggttgcagtgagctga

SEQ ID NO: 13066 - DNA, 32 bp, Homo sapiens
gaacctgggaggcagaggttgcagtgagccga

SEQ ID NO: 13067 - DNA, 32 bp, Homo sapiens
ccagctggcctgctgctctgcacagcaccggc

SEQ ID NO: 13068 - DNA, 32 bp, Homo sapiens
agcctccaaagtagctgggattacaggcaccc

SEQ ID NO: 13069 - DNA, 32 bp, Homo sapiens
actctgtcacccaagctggagtgcagtggtgc

SEQ ID NO: 13070 - DNA, 32 bp, Homo sapiens
ggccacagttccatgaatctttgctcccttcc

SEQ ID NO: 13071 - DNA, 32 bp, Homo sapiens
agaagctgaagaggataagagcaaggaaacaa

SEQ ID NO: 13072 - DNA, 24 bp, Homo sapiens
ctgaccaacatggtgaaacaccat

SEQ ID NO: 13073 - DNA, 32 bp, Homo sapiens
agtgggaaagagagggacgggtctgatgagtt

SEQ ID NO: 13074 - DNA, 32 bp, Homo sapiens
gaactggtcatagaggaagagctagaaatcca

SEQ ID NO: 13075 - DNA, 32 bp, Homo sapiens
acacatcacacagaattggagtgctgtccttc

SEQ ID NO: 13076 - DNA, 20 bp, Homo sapiens
cagcactactggtgcctgaa

SEQ ID NO: 13077 - DNA, 32 bp, Homo sapiens
tggtcttgggccagttctcccacgacggctca

SEQ ID NO: 13078 - DNA, 32 bp, Homo sapiens
gcagtggcctccatcctccctgctcagccaca

SEQ ID NO: 13079 - DNA, 32 bp, Homo sapiens
atccctcatcttctgaccctgggttctgggct

SEQ ID NO: 13080 - DNA, 24 bp, Homo sapiens
tcacgcctggaatcccagcacttt

SEQ ID NO: 13081 - DNA, 24 bp, Homo sapiens
tcacgcctgtaatcccatcacttt

SEQ ID NO: 13082 - DNA, 32 bp, Homo sapiens
agtcggggacaaggagcttccgtctggcaagg

SEQ ID NO: 13083 - DNA, 32 bp, Homo sapiens
aaaggtcttcaaggagttggtccaggtagcaa

SEQ ID NO: 13084 - DNA, 32 bp, Homo sapiens
actgaaactactggtgtttttctgccttgaga

SEQ ID NO: 13085 - DNA, 32 bp, Homo sapiens
cagtgctcctgactcctcacagctctgttcct

SEQ ID NO: 13086 - DNA, 18 bp, Homo sapiens
aaggggccacagctgctc

SEQ ID NO: 13087 - DNA, 32 bp, Homo sapiens
gctttagcctgagacttgccataagaaactgc

SEQ ID NO: 13088 - DNA, 32 bp, Homo sapiens
tgagcctgtaccactgttgtaacatgggaaga

SEQ ID NO: 13089 - DNA, 28 bp, Homo sapiens
ccttccggtggagctgcctcgttccttt

SEQ ID NO: 13090 - DNA, 32 bp, Homo sapiens
agccattcaagtgccttacacagctttgaaga

SEQ ID NO: 13091 - DNA, 32 bp, Homo sapiens
gagcccaggagtttgaggctgcagtgagctat

SEQ ID NO: 13092 - DNA, 32 bp, Homo sapiens
gaacccagcgggaagaggttgcagtgagccaa

SEQ ID NO: 13093 - DNA, 32 bp, Homo sapiens
gaacccaggaggcacaggttgcagtgagccag

SEQ ID NO: 13094 - DNA, 32 bp, Homo sapiens
ttagtgcctcttagtccatctgttccctctcc

SEQ ID NO: 13095 - DNA, 32 bp, Homo sapiens
aatttggggaacagacctccactgtgattcca

SEQ ID NO: 13096 - DNA, 32 bp, Homo sapiens
tggccgtatgaaggtgtctcccagaagcatta

SEQ ID NO: 13097 - DNA, 21 bp, Homo sapiens
ctggaggcccaaactgagttg

SEQ ID NO: 13098 - DNA, 21 bp, Homo sapiens
agtgagggcactgctcttgga

SEQ ID NO: 13099 - DNA, 32 bp, Homo sapiens
ggcaataggcctgggaaagtcgcactttcatc

SEQ ID NO: 13100 - DNA, 32 bp, Homo sapiens
ctgtcttgcccaggctggagttcaggggctat

SEQ ID NO: 13101 - DNA, 32 bp, Homo sapiens
cttcctccgtgtctgtcatacactgagaccaa

SEQ ID NO: 13102 - DNA, 21 bp, Homo sapiens
gccagtcaaggccacccagga

SEQ ID NO: 13103 - DNA, 32 bp, Homo sapiens
ggcctcctgagtagctgggatttcaggccatg

SEQ ID NO: 13104 - DNA, 32 bp, Homo sapiens
tctagtcgcctcctgccatctgatctccctcc

SEQ ID NO: 13105 - DNA, 24 bp, Homo sapiens
ctgtcactcaggctggagtgcagt

SEQ ID NO: 13106 - DNA, 32 bp, Homo sapiens
ctctatacatctctccccaaccctaggttccc

SEQ ID NO: 13107 - DNA, 32 bp, Homo sapiens
cttgttacaaacacacgatgcaccttaactca

SEQ ID NO: 13108 - DNA, 28 bp, Homo sapiens
ataccctggaacactgcctcattgtctt

SEQ ID NO: 13109 - DNA, 28 bp, Homo sapiens
gcgcagctgactgctgcctctcacggcc

SEQ ID NO: 13110 - DNA, 32 bp, Homo sapiens
gaggccaggagtttgaggctgcagtgagctat

SEQ ID NO: 13111 - DNA, 32 bp, Homo sapiens
cacaatcaacatcaaagtgaagctggatttct

SEQ ID NO: 13112 - DNA, 28 bp, Homo sapiens
tcccagccccctgctgccttctctatgc

SEQ ID NO: 13113 - DNA, 32 bp, Homo sapiens
agtctcctgagtagctgggatcacaggcatgc

SEQ ID NO: 13114 - DNA, 32 bp, Homo sapiens
tgaagagaggtatcattgctgtggaaaaatct

SEQ ID NO: 13115 - DNA, 32 bp, Homo sapiens
cgccgtcccagtgccctcagaggcacctagac

SEQ ID NO: 13116 - DNA, 32 bp, Homo sapiens
tgtctggagtcttttgccatctggatcttagt

SEQ ID NO: 13117 - DNA, 32 bp, Homo sapiens
actttgtcacccaggctggaatgcagtggcac

SEQ ID NO: 13118 - DNA, 32 bp, Homo sapiens
agcctcctgagtagctgggcttacaggcaccc

SEQ ID NO: 13119 - DNA, 32 bp, Homo sapiens
gcagcagcagcctcttcccatggatccaccac

SEQ ID NO: 13120 - DNA, 19 bp, Homo sapiens
caggctcactgcagcctca

SEQ ID NO: 13121 - DNA, 32 bp, Homo sapiens
ggacacctcctggcacaacaccaccttctttg

SEQ ID NO: 13122 - DNA, 32 bp, Homo sapiens
ctctgttgcccaggctccagtgcagtggtgtg

SEQ ID NO: 13123 - DNA, 32 bp, Homo sapiens
gcaagatgaagaggaaaaacaaacaaacaaac

SEQ ID NO: 13124 - DNA, 32 bp, Homo sapiens
gtgcttgccctctctactgtcccggcggcatc

SEQ ID NO: 13125 - DNA, 32 bp, Homo sapiens
gaacccgggaggcagaggttgctgtaagctga

SEQ ID NO: 13126 - DNA, 32 bp, Homo sapiens
atcacatgtaccactgctgctttgatggagct

SEQ ID NO: 13127 - DNA, 32 bp, Homo sapiens
acctccacctcccaggttcaagtgattctcct

SEQ ID NO: 13128 - DNA, 26 bp, Homo sapiens
accccatgaggacatgcagagcacct

SEQ ID NO: 13129 - DNA, 32 bp, Homo sapiens
ctgacctcaagtgatcctcccacctcagcctc

SEQ ID NO: 13130 - DNA, 32 bp, Homo sapiens
gctctgtcacccaggctggagtgccatagtgt

SEQ ID NO: 13131 - DNA, 32 bp, Homo sapiens
gtcgccaggctggaatgcagtgcagtgagcca

SEQ ID NO: 13132 - DNA, 32 bp, Homo sapiens
acttcagagccagcagtgtggctcaggtgcca

SEQ ID NO: 13133 - DNA, 32 bp, Homo sapiens
atgagtgtgctgctcaccttcccaagttctgt

SEQ ID NO: 13134 - DNA, 32 bp, Homo sapiens
tccgggtgccggttgaggttgctggtgggcct

SEQ ID NO: 13135 - DNA, 28 bp, Homo sapiens
ggctcaccgagaccagcctcatctcggg

SEQ ID NO: 13136 - DNA, 28 bp, Homo sapiens
aggccaccattgtctgcctcatcaggaa

SEQ ID NO: 13137 - DNA, 32 bp, Homo sapiens
ctcttgttgcccaggctggagtacaatggcgc

SEQ ID NO: 13138 - DNA, 32 bp, Homo sapiens
gctctgttacccatgctggagtacggtggcga

SEQ ID NO: 13139 - DNA, 32 bp, Homo sapiens
gaacctggaatacagaggtttcagtgagctga

SEQ ID NO: 13140 - DNA, 32 bp, Homo sapiens
gctggaaaccaagaggatccaaacttcctgca

SEQ ID NO: 13141 - DNA, 32 bp, Homo sapiens
gttggggagagagaaccctcactgtggggaat

SEQ ID NO: 13142 - DNA, 32 bp, Homo sapiens
ctcttgttgcccaggctggagtgcaatggcac

SEQ ID NO: 13143 - DNA, 32 bp, Homo sapiens
cgtgtatttaaccttgaagggttcaccaggtc

SEQ ID NO: 13144 - DNA, 32 bp, Homo sapiens
ctaagcagtttcatcagcattacttgggaaaa

SEQ ID NO: 13145 - DNA, 32 bp, Homo sapiens
atgacagaattgtcctggattttgactccatc

SEQ ID NO: 13146 - DNA, 32 bp, Homo sapiens
attgcccacttctgtgtagacatggttctggt

SEQ ID NO: 13147 - DNA, 32 bp, Homo sapiens
ggccagtgttgtctgtcatgtgccagaagctt

SEQ ID NO: 13148 - DNA, 32 bp, Homo sapiens
cctgagctgaatccttcaaaggcacagcaggc

SEQ ID NO: 13149 - DNA, 28 bp, Homo sapiens
agtcatccaggtgctgccacatgacagg

SEQ ID NO: 13150 - DNA, 32 bp, Homo sapiens
ccaggctgacctttatgctcccagaatcatca

SEQ ID NO: 13151 - DNA, 32 bp, Homo sapiens
gactaacaagacgagcgctctggatcttacta

SEQ ID NO: 13152 - DNA, 32 bp, Homo sapiens
accttcaccgcccaggttcaagcgattctctt

SEQ ID NO: 13153 - DNA, 32 bp, Homo sapiens
actctgttgcccaggctagagtgcactaatac

SEQ ID NO: 13154 - DNA, 32 bp, Homo sapiens
tgtgattcacccagatctgttgtgccagttag

SEQ ID NO: 13155 - DNA, 32 bp, Homo sapiens
ctactcgggaggctgaggcaggagaatggcgt

SEQ ID NO: 13156 - DNA, 18 bp, Homo sapiens
gcctcttctgcccaggtg

SEQ ID NO: 13157 - DNA, 32 bp, Homo sapiens
ggcctcccaaagtgctgggattagaggcatga

SEQ ID NO: 13158 - DNA, 32 bp, Homo sapiens
ctcatgaaggaagccattgcactgtgaacact

SEQ ID NO: 13159 - DNA, 32 bp, Homo sapiens
ccacagttcccaggctggggatgctttgcctt

SEQ ID NO: 13160 - DNA, 32 bp, Homo sapiens
agcccacatccctccttgggcagggcagcagc

SEQ ID NO: 13161 - DNA, 32 bp, Homo sapiens
ctggcatatcttctctgtgctggtgcacctag

SEQ ID NO: 13162 - DNA, 32 bp, Homo sapiens
gaatccgggaggcagaggttgcaggagctgag

SEQ ID NO: 13163 - DNA, 32 bp, Homo sapiens
tattggaagaggcagagcctgaggtggtagga

SEQ ID NO: 13164 - DNA, 32 bp, Homo sapiens
aaaaattctaaccactgtaacaacagtttttg

SEQ ID NO: 13165 - DNA, 32 bp, Homo sapiens
agctagccgggcatgaggagatcgtgtctcca

SEQ ID NO: 13166 - DNA, 32 bp, Homo sapiens
gaacccagggggtggaggttgcactgagccga

SEQ ID NO: 13167 - DNA, 32 bp, Homo sapiens
agccttctgagtagctgggactacaggcacat

SEQ ID NO: 13168 - DNA, 32 bp, Homo sapiens
caggggctgacggatcggggagaggctgggtg

SEQ ID NO: 13169 - DNA, 32 bp, Homo sapiens
gccacttgtctacaaccatctgatctttgaca

SEQ ID NO: 13170 - DNA, 32 bp, Homo sapiens
gactccgtgcctggacctgttacttgattagg

SEQ ID NO: 13171 - DNA, 32 bp, Homo sapiens
cccgagaagcttcctctcagtgaccacaatat

SEQ ID NO: 13172 - DNA, 32 bp, Homo sapiens
cccagctcaagtgatcctcccacctcagcctc

SEQ ID NO: 13173 - DNA, 32 bp, Homo sapiens
gtgtccccagttccgtctcagctacctggact

SEQ ID NO: 13174 - DNA, 20 bp, Homo sapiens
gcaaatgccaagtgctctgc

SEQ ID NO: 13175 - DNA, 32 bp, Homo sapiens
agcatatctaatatctaggttacttgagagac

SEQ ID NO: 13176 - DNA, 32 bp, Homo sapiens
ccatgttgcccaggctggaagtgtctatgttt

SEQ ID NO: 13177 - DNA, 32 bp, Homo sapiens
ctctgtcgcccaggtttgagtgcaatggcaca

SEQ ID NO: 13178 - DNA, 32 bp, Homo sapiens
aggagccttgcaggctggagggcggctggaga

SEQ ID NO: 13179 - DNA, 32 bp, Homo sapiens
ttcttgttgccgaggctggagtgcaatggcgc

SEQ ID NO: 13180 - DNA, 32 bp, Homo sapiens
ctcttagggaggcagaggcaggaggatagctt

SEQ ID NO: 13181 - DNA, 24 bp, Homo sapiens
ctgtcacccaggctggagtacaat

SEQ ID NO: 13182 - DNA, 24 bp, Homo sapiens
ttgtcacctagactggagtgcaat

SEQ ID NO: 13183 - DNA, 32 bp, Homo sapiens
agcctcccaagtagctgggattacaggcacgc

SEQ ID NO: 13184 - DNA, 32 bp, Homo sapiens
gctccccattgattgaagagtcactgtctgaa

SEQ ID NO: 13185 - DNA, 31 bp, Homo sapiens
gccaacaacaacagaacagggtggagtgagt

SEQ ID NO: 13186 - DNA, 32 bp, Homo sapiens
ccttaatcaagcaaacttccctcttcagaaaa

SEQ ID NO: 13187 - DNA, 23 bp, Homo sapiens
agagaggcctgaacctgttgact

SEQ ID NO: 13188 - DNA, 18 bp, Homo sapiens
tttggaatctctgaagta

SEQ ID NO: 13189 - DNA, 19 bp, Homo sapiens
ggccaggctagagtgcagt

SEQ ID NO: 13190 - DNA, 32 bp, Homo sapiens
gacaccgcagttctgttcagccatcagaagag

SEQ ID NO: 13191 - DNA, 24 bp, Homo sapiens
ctgaccaacatggtgaaacctcat

SEQ ID NO: 13192 - DNA, 32 bp, Homo sapiens
ttgagatggagtttcgctctgttgccaggctg

SEQ ID NO: 13193 - DNA, 32 bp, Homo sapiens
catgagttcccccaactggagtgcagacaaga

SEQ ID NO: 13194 - DNA, 32 bp, Homo sapiens
ggggcttcaaaccacttaggaccgactgctga

SEQ ID NO: 13195 - DNA, 32 bp, Homo sapiens
ctcccaaaccagagtcatatgctgctagtaga

SEQ ID NO: 13196 - DNA, 32 bp, Homo sapiens
acatatgttgcaagaccctcccatgggggcac

SEQ ID NO: 13197 - DNA, 32 bp, Homo sapiens
actctgtcacccaggctggagtgcagtggctt

SEQ ID NO: 13198 - DNA, 32 bp, Homo sapiens
gacccaggctctgaagattcccagaagccaca

SEQ ID NO: 13199 - DNA, 32 bp, Homo sapiens
aaacccgggaggcagaggctgcagagagccaa

SEQ ID NO: 13200 - DNA, 32 bp, Homo sapiens
ggcacatgcctgtaatcccagcactttggggg

SEQ ID NO: 13201 - DNA, 32 bp, Homo sapiens
tatggagcctccatcatcatgctcttttgtga

SEQ ID NO: 13202 - DNA, 32 bp, Homo sapiens
gttctgttgcctaggccagagtgcagtggcat

SEQ ID NO: 13203 - DNA, 21 bp, Homo sapiens
aggcccatccatcccatgcct

SEQ ID NO: 13204 - DNA, 32 bp, Homo sapiens
aacaggagccgatgccaaatggtctagaggca

SEQ ID NO: 13205 - DNA, 32 bp, Homo sapiens
ctgggctcaagcaatcttcccacctcagcctc

SEQ ID NO: 13206 - DNA, 32 bp, Homo sapiens
gtagacagaagaggaagaaagaacagatgttc

SEQ ID NO: 13207 - DNA, 32 bp, Homo sapiens
aggatacaagggcctacccagagaccagagag

SEQ ID NO: 13208 - DNA, 15 bp, Homo sapiens
gcccctgccctgggg

SEQ ID NO: 13209 - DNA, 32 bp, Homo sapiens
gaacccaggaggtgaaggttgcagtgaccgga

SEQ ID NO: 13210 - DNA, 28 bp, Homo sapiens
atctatcttcctgtagcctcatcaatcc

SEQ ID NO: 13211 - DNA, 32 bp, Homo sapiens
gcatttgatttccaagtcaggtagatcattgg

SEQ ID NO: 13212 - DNA, 32 bp, Homo sapiens
cagttaaggccccatccatctgagctctgaat

SEQ ID NO: 13213 - DNA, 32 bp, Homo sapiens
gcccaatctgccaggctggactgtgctgttcc

SEQ ID NO: 13214 - DNA, 32 bp, Homo sapiens
ctcactcttcaaggaggcccactgtgtctagg

SEQ ID NO: 13215 - DNA, 32 bp, Homo sapiens
ggttctcgtctgcagaccctctggacctggtc

SEQ ID NO: 13216 - DNA, 22 bp, Homo sapiens
tcatgcctgtaatcccagtact

SEQ ID NO: 13217 - DNA, 32 bp, Homo sapiens
cttaggcattctaagtcacaggatgagacagg

SEQ ID NO: 13218 - DNA, 19 bp, Homo sapiens
gccaaacacctacccagaa

SEQ ID NO: 13219 - DNA, 32 bp, Homo sapiens
ggggccgcgctctcttctgggagggcagcggc

SEQ ID NO: 13220 - DNA, 21 bp, Homo sapiens
ctggccaacatggcaaaaccc

SEQ ID NO: 13221 - DNA, 32 bp, Homo sapiens
gttgagctgggctctcgctttgttgcccaggc

SEQ ID NO: 13222 - DNA, 22 bp, Homo sapiens
gggccctcctctcctcctcaca

SEQ ID NO: 13223 - DNA, 32 bp, Homo sapiens
cttctctgcccaggccgctgcagctgcacagc

SEQ ID NO: 13224 - DNA, 32 bp, Homo sapiens
gagtacgttgaagaagaaagaagagaaaggta

SEQ ID NO: 13225 - DNA, 32 bp, Homo sapiens
tagtatctcattctgtcatcagatccagaaga

SEQ ID NO: 13226 - DNA, 32 bp, Homo sapiens
aaagcttcaaaccgtttgtaaggttaaagaaa

SEQ ID NO: 13227 - DNA, 32 bp, Homo sapiens
ccagtgctgggtgcgcttaacaactgcgttct

SEQ ID NO: 13228 - DNA, 32 bp, Homo sapiens
ctactgtcatacaggctggcgtgcagtagtgg

SEQ ID NO: 13229 - DNA, 32 bp, Homo sapiens
tgggaggtggaggggaggctgcagtgagctga

SEQ ID NO: 13230 - DNA, 32 bp, Homo sapiens
gactccaggaggcgcaggctgcagtgagctct

SEQ ID NO: 13231 - DNA, 32 bp, Homo sapiens
ctgctttcaagcaccacacccacccagatgac

SEQ ID NO: 13232 - DNA, 32 bp, Homo sapiens
gctcacgggcctggggccatggctttcttctc

SEQ ID NO: 13233 - DNA, 32 bp, Homo sapiens
aaggcaaatgttcattgtttaattagcactgg

SEQ ID NO: 13234 - DNA, 32 bp, Homo sapiens
cggcccagctgtgtgcacaggtgcaggaggac

SEQ ID NO: 13235 - DNA, 18 bp, Homo sapiens
gcccaactctgtccggta

SEQ ID NO: 13236 - DNA, 22 bp, Homo sapiens
tcacgcctgtaacctcagcact

SEQ ID NO: 13237 - DNA, 32 bp, Homo sapiens
caggagcatcttcttggcagccaggctgggcc

SEQ ID NO: 13238 - DNA, 32 bp, Homo sapiens
gctatacatcttcatccctccccaccatcctg

SEQ ID NO: 13239 - DNA, 32 bp, Homo sapiens
atctgcagtgttgaggccagtcactgttggaa

SEQ ID NO: 13240 - DNA, 23 bp, Homo sapiens
tggcatggtctcagctcactgta

SEQ ID NO: 13241 - DNA, 32 bp, Homo sapiens
ctctcagtcctgatgtcacaggcgcggcaagg

SEQ ID NO: 13242 - DNA, 32 bp, Homo sapiens
actgtggcggcggctcctcttctgcctgtgta

SEQ ID NO: 13243 - DNA, 32 bp, Homo sapiens
atctcaggggaaatgtggctctctccaccttg

SEQ ID NO: 13244 - DNA, 32 bp, Homo sapiens
agagctgcagaaccagtccctctgagtgaagt

SEQ ID NO: 13245 - DNA, 23 bp, Homo sapiens
tggcgctatctcagctcgctgca

SEQ ID NO: 13246 - DNA, 32 bp, Homo sapiens
ccttagtgtaccacccctgccttgagcttgtg

SEQ ID NO: 13247 - DNA, 28 bp, Homo sapiens
tcggggctgggcgctgcctctcggtcga

SEQ ID NO: 13248 - DNA, 32 bp, Homo sapiens
gtggcagcctccatctccagcaagtctcctgg

SEQ ID NO: 13249 - DNA, 32 bp, Homo sapiens
accatgttgcccaggctggtgtcaaactcctg

SEQ ID NO: 13250 - DNA, 32 bp, Homo sapiens
gagcccaggaggttgtggctgcagtgagctgt

SEQ ID NO: 13251 - DNA, 32 bp, Homo sapiens
agcctcccgagtagctgggattacaagtgcac

SEQ ID NO: 13252 - DNA, 32 bp, Homo sapiens
agtagcccaacaacaaggctgctgggggcctg

SEQ ID NO: 13253 - DNA, 32 bp, Homo sapiens
taatactgatgtgatggatgcatttgttttgc

SEQ ID NO: 13254 - DNA, 32 bp, Homo sapiens
tcacgctggtttctccccaggacccatgagct

SEQ ID NO: 13255 - DNA, 32 bp, Homo sapiens
ctaaagacatgtggaggaagtcactgttaaat

SEQ ID NO: 13256 - DNA, 22 bp, Homo sapiens
tcacgggtgccctgtgacccca

SEQ ID NO: 13257 - DNA, 32 bp, Homo sapiens
ctcttctttaactgggaacacaggctctcaca

SEQ ID NO: 13258 - DNA, 32 bp, Homo sapiens
gccccaggagcctctcaggagtctacatccca

SEQ ID NO: 13259 - DNA, 32 bp, Homo sapiens
aatcattttctcagttctcttctttctttagc

SEQ ID NO: 13260 - DNA, 32 bp, Homo sapiens
ctctgtgtcccaggctggagtgcagtggcaca

SEQ ID NO: 13261 - DNA, 32 bp, Homo sapiens
ctctgttgctcaggctggattgcagtggcgtg

SEQ ID NO: 13262 - DNA, 32 bp, Homo sapiens
actcccggaggaggagaacaaagaaacgaggc

SEQ ID NO: 13263 - DNA, 32 bp, Homo sapiens
atatgagggagattgaggctgcagtgagctgt

SEQ ID NO: 13264 - DNA, 32 bp, Homo sapiens
tagaattaacaccattatgtattttgttattt

SEQ ID NO: 13265 - DNA, 24 bp, Homo sapiens
tcatgcctgtaatcccagcatttt

SEQ ID NO: 13266 - DNA, 32 bp, Homo sapiens
gtgggagcctccatccgctgctctttaccttt

SEQ ID NO: 13267 - DNA, 32 bp, Homo sapiens
cattgtggagcacaggcttacacccttcgtgg

SEQ ID NO: 13268 - DNA, 32 bp, Homo sapiens
ttgctgttagaggctctttcccagaagttgga

SEQ ID NO: 13269 - DNA, 32 bp, Homo sapiens
aaatgtcatcttctccccagacgctggcttgc

SEQ ID NO: 13270 - DNA, 24 bp, Homo sapiens
tcatgcctgtaaccccagcacttt

SEQ ID NO: 13271 - DNA, 32 bp, Homo sapiens
tcttgtcccccaggcttgagtgcaatgactca

SEQ ID NO: 13272 - DNA, 32 bp, Homo sapiens
cagcagaaaatctactctttagcaatatataa

SEQ ID NO: 13273 - DNA, 32 bp, Homo sapiens
ggaggaagaagaggaggaggaggaggaggagg

SEQ ID NO: 13274 - DNA, 28 bp, Homo sapiens
gcggcttccggtgctgcctgcgtcatct

SEQ ID NO: 13275 - DNA, 32 bp, Homo sapiens
actctgtcacccaggctggagtgcaatggcgt

SEQ ID NO: 13276 - DNA, 32 bp, Homo sapiens
actctgttacccaggctagagtgcagtggcgc

SEQ ID NO: 13277 - DNA, 32 bp, Homo sapiens
gctaacgggaggcagtgtgatgtggaggggaa

SEQ ID NO: 13278 - DNA, 32 bp, Homo sapiens
ttcttaaccatcagccatgtgctgctatttct

SEQ ID NO: 13279 - DNA, 32 bp, Homo sapiens
tacctcctgagtaactgggattacagtcgtgt

SEQ ID NO: 13280 - DNA, 32 bp, Homo sapiens
ctctcgttgccgaggctggagtgtagtagtgt

SEQ ID NO: 13281 - DNA, 32 bp, Homo sapiens
actttgcttcccaggctggagtgcagtggtgc

SEQ ID NO: 13282 - DNA, 32 bp, Homo sapiens
aggtttgtgctgcgcttccagttccgaaaagc

SEQ ID NO: 13283 - DNA, 32 bp, Homo sapiens
cgtcttgctttgtgccccatctgtgcctggat

SEQ ID NO: 13284 - DNA, 32 bp, Homo sapiens
ctgggttcaagcagttcttccccatcagcctc

SEQ ID NO: 13285 - DNA, 32 bp, Homo sapiens
gcttgttgcccaggctggagtgcaatggcgcg

SEQ ID NO: 13286 - DNA, 32 bp, Homo sapiens
ctctgtcgcccaggctggagtgcagtagcgcg

SEQ ID NO: 13287 - DNA, 32 bp, Homo sapiens
ctctgtcgcccaggctggggtgcagtggcgcg

SEQ ID NO: 13288 - DNA, 28 bp, Homo sapiens
ctctgctcttctgcagcctcatctctgc

SEQ ID NO: 13289 - DNA, 32 bp, Homo sapiens
actgtatcacccaggccagagtgtagtggcac

SEQ ID NO: 13290 - DNA, 32 bp, Homo sapiens
cagcctttctccaggtgggagtgcagtggcat

SEQ ID NO: 13291 - DNA, 32 bp, Homo sapiens
ccgggttcaagcaattctcatgcatcagcctc

SEQ ID NO: 13292 - DNA, 32 bp, Homo sapiens
gctctgtcgcccaggctggaatgctgtagcaa

SEQ ID NO: 13293 - DNA, 32 bp, Homo sapiens
gttctgctgcccaggttggagtgcagtggcac

SEQ ID NO: 13294 - DNA, 32 bp, Homo sapiens
cttagagcctgagttgctccacaggaatccag

SEQ ID NO: 13295 - DNA, 32 bp, Homo sapiens
tggggtcaagacagatgacaccagcactttaa

SEQ ID NO: 13296 - DNA, 32 bp, Homo sapiens
gtgacggtgatctcggggtgggcaggactcca

SEQ ID NO: 13297 - DNA, 32 bp, Homo sapiens
ctatgttgcccaggctagagtgcagtggctat

SEQ ID NO: 13298 - DNA, 32 bp, Homo sapiens
ttgagacagagtttcgcttttgttgcccgggc

SEQ ID NO: 13299 - DNA, 23 bp, Homo sapiens
tggcactatcttggctcattgca

SEQ ID NO: 13300 - DNA, 32 bp, Homo sapiens
gcctccaactcttgggttcaagcaaccctgcc

SEQ ID NO: 13301 - DNA, 28 bp, Homo sapiens
cttccagatgttgctgccttatcgaaat

SEQ ID NO: 13302 - DNA, 28 bp, Homo sapiens
cactgacccccaggggcctcatcctccc

SEQ ID NO: 13303 - DNA, 32 bp, Homo sapiens
cttgtgtcacccaggctggagtgcaatggcgc

SEQ ID NO: 13304 - DNA, 32 bp, Homo sapiens
gagcacaggagacggaggttgctgtgagctga

SEQ ID NO: 13305 - DNA, 32 bp, Homo sapiens
ttataagaaatgacatttatggaacacttatt

SEQ ID NO: 13306 - DNA, 32 bp, Homo sapiens
tggtctgtcgccaggctggagtgcagtggcgc

SEQ ID NO: 13307 - DNA, 32 bp, Homo sapiens
ctctggttgcccaggctggggtacagtggtgg

SEQ ID NO: 13308 - DNA, 32 bp, Homo sapiens
gggtgaatggaatgagctggagcttgaacaaa

SEQ ID NO: 13309 - DNA, 32 bp, Homo sapiens
gggctttggcctgggcagcttccactttctgc

SEQ ID NO: 13310 - DNA, 32 bp, Homo sapiens
ctgtaatcaagaaatggcctgtggaatgttat

SEQ ID NO: 13311 - DNA, 32 bp, Homo sapiens
tcctgtcaagagacctaggtctactgatggca

SEQ ID NO: 13312 - DNA, 32 bp, Homo sapiens
attcaaaatttccagatttgggctatttctgt

SEQ ID NO: 13313 - DNA, 32 bp, Homo sapiens
ccaggctcaagcaatccttgtgcctcagcctc

SEQ ID NO: 13314 - DNA, 32 bp, Homo sapiens
ccgggttcacggcattctcccgcctcagcctc

SEQ ID NO: 13315 - DNA, 32 bp, Homo sapiens
ttcctaagagcctctttccttcataccatctt

SEQ ID NO: 13316 - DNA, 32 bp, Homo sapiens
ccggactctgcagtttctcctgcactgttttc

SEQ ID NO: 13317 - DNA, 32 bp, Homo sapiens
ctctctggtcttctcccaggctggatctgggc

SEQ ID NO: 13318 - DNA, 32 bp, Homo sapiens
aaaataataacaggctgggtgcaatggctcac

SEQ ID NO: 13319 - DNA, 22 bp, Homo sapiens
ggccaacatggtgaaacccgtc

SEQ ID NO: 13320 - DNA, 32 bp, Homo sapiens
gtcctaggtggggttctctttgttgcctacca

SEQ ID NO: 13321 - DNA, 32 bp, Homo sapiens
gcactgttgcccaggctggagagcagtggcgc

SEQ ID NO: 13322 - DNA, 32 bp, Homo sapiens
tgaacccggaggcagaggttgcagtgagccga

SEQ ID NO: 13323 - DNA, 32 bp, Homo sapiens
aagtgccttccgcttccatctgctccgcccag

SEQ ID NO: 13324 - DNA, 32 bp, Homo sapiens
gcgctgttgcccaggctggagtgcagtggcgt

SEQ ID NO: 13325 - DNA, 32 bp, Homo sapiens
gctctgtcgcccaggctggagtgcaggggcgc

SEQ ID NO: 13326 - DNA, 32 bp, Homo sapiens
ttcaaatctttcctccccatttgtgagctgtg

SEQ ID NO: 13327 - DNA, 32 bp, Homo sapiens
tgtagcccatggccagtctgtcactgtgtcct

SEQ ID NO: 13328 - DNA, 32 bp, Homo sapiens
ctggccaggcctggcacagccctggcttccac

SEQ ID NO: 13329 - DNA, 18 bp, Homo sapiens
atgtagggaagccttcag

SEQ ID NO: 13330 - DNA, 32 bp, Homo sapiens
aagatggggataatgtggaaatggcagttgtc

SEQ ID NO: 13331 - DNA, 32 bp, Homo sapiens
ctctgccatcttctctccttcccaaaggatct

SEQ ID NO: 13332 - DNA, 32 bp, Homo sapiens
tcccgtccaacaggctggagtacaatggcgag

SEQ ID NO: 13333 - DNA, 32 bp, Homo sapiens
gtctcctgtagggcttatgactgtgaatcctt

SEQ ID NO: 13334 - DNA, 21 bp, Homo sapiens
ccttagcagcccagcatttcc

SEQ ID NO: 13335 - DNA, 32 bp, Homo sapiens
ctgccttgcccaggggtgggatggcactgaag

SEQ ID NO: 13336 - DNA, 32 bp, Homo sapiens
gtctgtcacccaggctggagtacagtggcatg

SEQ ID NO: 13337 - DNA, 32 bp, Homo sapiens
gtctgtcacccaggctggagtgcagtggcgtg

SEQ ID NO: 13338 - DNA, 32 bp, Homo sapiens
gagcccaggaggtcaaggctgcagtgagctgc

SEQ ID NO: 13339 - DNA, 32 bp, Homo sapiens
acttccgcctcctgggttcaagcaattctcct

SEQ ID NO: 13340 - DNA, 32 bp, Homo sapiens
acctccgccttctgggttcaagcaattctcct

SEQ ID NO: 13341 - DNA, 32 bp, Homo sapiens
atctcagcctgagacgcacagagaggtctctt

SEQ ID NO: 13342 - DNA, 32 bp, Homo sapiens
gaacccaggaggtagaggttgcagtgagccga

SEQ ID NO: 13343 - DNA, 32 bp, Homo sapiens
gaacttgggaggcagaggttgtggtgagccga

SEQ ID NO: 13344 - DNA, 32 bp, Homo sapiens
gattgccaacgcctctggagtgctggctggga

SEQ ID NO: 13345 - DNA, 32 bp, Homo sapiens
tctctgtcgcctaggctggagtgcagtggtgc

SEQ ID NO: 13346 - DNA, 32 bp, Homo sapiens
gtgaggggctgagaggaatacttgaaacaaca

SEQ ID NO: 13347 - DNA, 18 bp, Homo sapiens
cctctcctgccacccaga

SEQ ID NO: 13348 - DNA, 32 bp, Homo sapiens
catcttaactgcacagataccatcttctcggc

SEQ ID NO: 13349 - DNA, 32 bp, Homo sapiens
cctccccacacaacaggctacgaagaacctgg

SEQ ID NO: 13350 - DNA, 32 bp, Homo sapiens
taaagaatgccatggccgggtgcagtggctca

SEQ ID NO: 13351 - DNA, 32 bp, Homo sapiens
gacggtggccctcttctcacagctccactagg

SEQ ID NO: 13352 - DNA, 19 bp, Homo sapiens
gccctcagccagcccagaa

SEQ ID NO: 13353 - DNA, 32 bp, Homo sapiens
tgcccaggcacacgctggactcctgtggggtg

SEQ ID NO: 13354 - DNA, 32 bp, Homo sapiens
ccccgtcgcacaggctggagtgcagtggcaaa

SEQ ID NO: 13355 - DNA, 32 bp, Homo sapiens
tgtctgtgcatcctgaaccactctttgctggg

SEQ ID NO: 13356 - DNA, 32 bp, Homo sapiens
agcctccctagtagctgggattacaggtgcac

SEQ ID NO: 13357 - DNA, 32 bp, Homo sapiens
tgaagctctgaaatgcgatgtgatctgtacca

SEQ ID NO: 13358 - DNA, 32 bp, Homo sapiens
gaacccgggagacggcgcttgcagtgagccga

SEQ ID NO: 13359 - DNA, 32 bp, Homo sapiens
agcctcccaagtagctgggattactggtgcac

SEQ ID NO: 13360 - DNA, 32 bp, Homo sapiens
agactcctaagtagctgggattacaggcacct

SEQ ID NO: 13361 - DNA, 32 bp, Homo sapiens
agcctcccgagtagctgggattgcaggagcct

SEQ ID NO: 13362 - DNA, 32 bp, Homo sapiens
tcctgatcccatctcactctctggacctacca

SEQ ID NO: 13363 - DNA, 32 bp, Homo sapiens
ctgggacatcttcccttggatcaggatccttc

SEQ ID NO: 13364 - DNA, 32 bp, Homo sapiens
tcagtctcacgacctacccccaccccggactg

SEQ ID NO: 13365 - DNA, 32 bp, Homo sapiens
ctggctgtgctgctgctgctacccctcccaag

SEQ ID NO: 13366 - DNA, 32 bp, Homo sapiens
caagtgtgagcctattgtgttacttgacctta

SEQ ID NO: 13367 - DNA, 21 bp, Homo sapiens
cgcccacccccggctccagga

SEQ ID NO: 13368 - DNA, 32 bp, Homo sapiens
cccagtcacatcctgagctgctcctggctgat

SEQ ID NO: 13369 - DNA, 32 bp, Homo sapiens
caagataatcagctatatgaagaatctcagct

SEQ ID NO: 13370 - DNA, 21 bp, Homo sapiens
cagggaagctcctcctcagct

SEQ ID NO: 13371 - DNA, 32 bp, Homo sapiens
gctctgtcgtccaggctggagtgcagtggcgc

SEQ ID NO: 13372 - DNA, 32 bp, Homo sapiens
attctgtcacccaggctggagtgcagtggcgc

SEQ ID NO: 13373 - DNA, 32 bp, Homo sapiens
ggatcccagtgttgccttaacagggtgtctgt

SEQ ID NO: 13374 - DNA, 32 bp, Homo sapiens
tagacagtattattacattcagtattacaatg

SEQ ID NO: 13375 - DNA, 32 bp, Homo sapiens
cctgccaggcctgcacagccttggcttcacgc

SEQ ID NO: 13376 - DNA, 32 bp, Homo sapiens
tctttgttgctcaggctggagtacagtggcat

SEQ ID NO: 13377 - DNA, 32 bp, Homo sapiens
acactgtacctggcttctcttcttcctttcct

SEQ ID NO: 13378 - DNA, 32 bp, Homo sapiens
cattcccactgcacttggtgctgctttggctg

SEQ ID NO: 13379 - DNA, 32 bp, Homo sapiens
tgtgccaggtactgttctgagcactttacaaa

SEQ ID NO: 13380 - DNA, 32 bp, Homo sapiens
cggcagagcccaggctggggaagtgaactacc

SEQ ID NO: 13381 - DNA, 32 bp, Homo sapiens
attaattatttggttgttttgttttcattttt

SEQ ID NO: 13382 - DNA, 32 bp, Homo sapiens
gggcgggtgtgcaggctcacaggctctggaaa

SEQ ID NO: 13383 - DNA, 32 bp, Homo sapiens
ctctgtcgcccagggtggagtgcggtggcacg

SEQ ID NO: 13384 - DNA, 32 bp, Homo sapiens
ctctgtggcccaggctggagtgcagtggcaca

SEQ ID NO: 13385 - DNA, 32 bp, Homo sapiens
catggccacatcctgaatgttgacaataccct

SEQ ID NO: 13386 - DNA, 32 bp, Homo sapiens
ttaacaggagggcagagggcaggggacagacg

SEQ ID NO: 13387 - DNA, 32 bp, Homo sapiens
gtgctgccatcagtttcacttctgccttggaa

SEQ ID NO: 13388 - DNA, 32 bp, Homo sapiens
ctggccatgcccagggctggtgttggttgagg

SEQ ID NO: 13389 - DNA, 32 bp, Homo sapiens
tttgacattggagaattggagtgcagtcataa

SEQ ID NO: 13390 - DNA, 32 bp, Homo sapiens
tgttgagaccagtcatgacagcattcaagatt

SEQ ID NO: 13391 - DNA, 32 bp, Homo sapiens
tgcctggggcctgctctctcccaggaattctc

SEQ ID NO: 13392 - DNA, 32 bp, Homo sapiens
accacccagctttctcccagccacagccaaga

SEQ ID NO: 13393 - DNA, 32 bp, Homo sapiens
gtctctgctctcctgaatcttgggcatgcctt

SEQ ID NO: 13394 - DNA, 32 bp, Homo sapiens
ttgggcttgggcctgggtctttgctgccaggt

SEQ ID NO: 13395 - DNA, 32 bp, Homo sapiens
tgtgtgcctatgagattgggtgcagtgtatcc

SEQ ID NO: 13396 - DNA, 32 bp, Homo sapiens
acctctgccttctgggttcaagcaattgtcct

SEQ ID NO: 13397 - DNA, 32 bp, Homo sapiens
gaacccaggaggtggaggttgctgtgagccaa

SEQ ID NO: 13398 - DNA, 32 bp, Homo sapiens
ctttaggggaggcaggcaggtgggtgagcagc

SEQ ID NO: 13399 - DNA, 32 bp, Homo sapiens
tttaggatttgagctgttctggaacacattgc

SEQ ID NO: 13400 - DNA, 32 bp, Homo sapiens
ctcctgttgtgcaggctgtagtgcagtggcac

SEQ ID NO: 13401 - DNA, 32 bp, Homo sapiens
cacattcctagagaggagccaagttctagtag

SEQ ID NO: 13402 - DNA, 32 bp, Homo sapiens
gaacctgggaggtggaggttgctgtgagctga

SEQ ID NO: 13403 - DNA, 32 bp, Homo sapiens
agaagagggagaagcacgtcactgtggttgta

SEQ ID NO: 13404 - DNA, 32 bp, Homo sapiens
agccaagctcaaggatggaagtgcagttaggg

SEQ ID NO: 13405 - DNA, 32 bp, Homo sapiens
gctctgtcccccaggctggagtgcagtggcat

SEQ ID NO: 13406 - DNA, 32 bp, Homo sapiens
agcctcctgagtagctggcattataggtgccc

SEQ ID NO: 13407 - DNA, 32 bp, Homo sapiens
ttaagaaagaattggacgttagaagttgtcat

SEQ ID NO: 13408 - DNA, 32 bp, Homo sapiens
acctacccaacaagaaccaacctgagcagctg

SEQ ID NO: 13409 - DNA, 32 bp, Homo sapiens
cgcgtcagcggattatggattactatgagacc

SEQ ID NO: 13410 - DNA, 32 bp, Homo sapiens
ggcttctgatggtcagcatcttccccaacact

SEQ ID NO: 13411 - DNA, 24 bp, Homo sapiens
cctagcctcacccccttgctctca

SEQ ID NO: 13412 - DNA, 32 bp, Homo sapiens
cactcttgcccaggctggagcgcaagtggcgc

SEQ ID NO: 13413 - DNA, 32 bp, Homo sapiens
atgcctgtggtcatgctctcagctccacctgg

SEQ ID NO: 13414 - DNA, 32 bp, Homo sapiens
ccacctagcaaatattatgtgcctgctgtgtg

SEQ ID NO: 13415 - DNA, 32 bp, Homo sapiens
  misc_feature (31)..(31): n is a, c, g or t
ctattcgggaggctgaggcaggagaatggcnt

SEQ ID NO: 13416 - DNA, 32 bp, Homo sapiens
ccgggttcaagcaattctcctgcctaagcctc

SEQ ID NO: 13417 - DNA, 32 bp, Homo sapiens
gctccctcatagtctacccccacgcctcagtg

SEQ ID NO: 13418 - DNA, 32 bp, Homo sapiens
tctcagaaagcctttctgactgatctcagcat

SEQ ID NO: 13419 - DNA, 32 bp, Homo sapiens
ttggggcagctttccggttatataacacattg

SEQ ID NO: 13420 - DNA, 21 bp, Homo sapiens
tgtgaagggggagatgggaga

SEQ ID NO: 13421 - DNA, 21 bp, Homo sapiens
cacacaggacagcagaagatc

SEQ ID NO: 13422 - DNA, 24 bp, Homo sapiens
tgacacaatcatggctcactgcag

SEQ ID NO: 13423 - DNA, 32 bp, Homo sapiens
accctggtcttgctgctcatatctgccaggaa

SEQ ID NO: 13424 - DNA, 32 bp, Homo sapiens
atgagggttcactcttcttgttgtacatgctg

SEQ ID NO: 13425 - DNA, 32 bp, Homo sapiens
catagtatagtcctgaatatgtacttttaaca

SEQ ID NO: 13426 - DNA, 32 bp, Homo sapiens
cttcgcccagttccctgcatcctaagactcga

SEQ ID NO: 13427 - DNA, 32 bp, Homo sapiens
agttcgtcagaacttaaatactgaggaagaag

SEQ ID NO: 13428 - DNA, 32 bp, Homo sapiens
ctggcttgcccaggctggagtgcggtggctag

SEQ ID NO: 13429 - DNA, 32 bp, Homo sapiens
gtaagcaaatttatgaatctttgtacaccata

SEQ ID NO: 13430 - DNA, 32 bp, Homo sapiens
ttcactcttaccaagaatctttgatgcagctt

SEQ ID NO: 13431 - DNA, 32 bp, Homo sapiens
atctccgcctcccaggttcaagcgattctcct

SEQ ID NO: 13432 - DNA, 32 bp, Homo sapiens
gctctgttacccagactggagtacagggatgc

SEQ ID NO: 13433 - DNA, 32 bp, Homo sapiens
aacctgggaggcggaggttgcagtggccgaga

SEQ ID NO: 13434 - DNA, 32 bp, Homo sapiens
gaacctgggaggtacaggttgcagtgagccca

SEQ ID NO: 13435 - DNA, 32 bp, Homo sapiens
gaactcgggaggcagaggttgcagtgagctga

SEQ ID NO: 13436 - DNA, 32 bp, Homo sapiens
aattgaggccttgaggaatgaagctttgaagg

SEQ ID NO: 13437 - DNA, 32 bp, Homo sapiens
gaacctgggaggtagaggttgcagtgagccga

SEQ ID NO: 13438 - DNA, 32 bp, Homo sapiens
gaatccgggaggcagagattgcagtgggccta

SEQ ID NO: 13439 - DNA, 24 bp, Homo sapiens
ctgtcgtccaggctggagtgcagt

SEQ ID NO: 13440 - DNA, 32 bp, Homo sapiens
cagtgccctggagtcctatctgatctccgggt

SEQ ID NO: 13441 - DNA, 32 bp, Homo sapiens
gctccgcttcccaggctggggtgcagtggtgc

SEQ ID NO: 13442 - DNA, 22 bp, Homo sapiens
cgctcccagccccaccccggga

SEQ ID NO: 13443 - DNA, 32 bp, Homo sapiens
ttttgaaactgcactaaatttttcttaacatt

SEQ ID NO: 13444 - DNA, 32 bp, Homo sapiens
ccaggttcaagtgattctccctgcctccgcct

SEQ ID NO: 13445 - DNA, 32 bp, Homo sapiens
cagtcatcatgggtgtttttgtcaactgcttg

SEQ ID NO: 13446 - DNA, 25 bp, Homo sapiens
ctgtaagatcaatacttgttgcaga

SEQ ID NO: 13447 - DNA, 32 bp, Homo sapiens
ctccccttctttctcttccttctgcctccccc

SEQ ID NO: 13448 - DNA, 32 bp, Homo sapiens
tcttgttgcccaggctggagtgcggtggtaca

SEQ ID NO: 13449 - DNA, 32 bp, Homo sapiens
tcactgttccaggaattcttgcagtgtagagg

SEQ ID NO: 13450 - DNA, 32 bp, Homo sapiens
aaactgctgaaaaagctgggtgcagtgaaatg

SEQ ID NO: 13451 - DNA, 32 bp, Homo sapiens
cacgaggggaggcacggtgcggagagcgtcgc

SEQ ID NO: 13452 - DNA, 32 bp, Homo sapiens
ctcttgttgcccaggctggagtgcggtggtac

SEQ ID NO: 13453 - DNA, 32 bp, Homo sapiens
agtctgtcacccaggctggagtgatctcagct

SEQ ID NO: 13454 - DNA, 32 bp, Homo sapiens
ctgggaaacaggcagaggttggaacagtttgg

SEQ ID NO: 13455 - DNA, 32 bp, Homo sapiens
gtttattatcttctccacgacctcacctatac

SEQ ID NO: 13456 - DNA, 32 bp, Homo sapiens
agtctgccgagtagctgggattacaggcatgc

SEQ ID NO: 13457 - DNA, 32 bp, Homo sapiens
attggcccaacaagaaggtttctgtcctaatc

SEQ ID NO: 13458 - DNA, 32 bp, Homo sapiens
tcacagaaactggggaagggaaaacaaacctt

SEQ ID NO: 13459 - DNA, 32 bp, Homo sapiens
cttgaaactcagcttgaagatttcagcaaatg

SEQ ID NO: 13460 - DNA, 32 bp, Homo sapiens
cagtcctctcctgctgtcacagctgccatcca

SEQ ID NO: 13461 - DNA, 32 bp, Homo sapiens
ctgtgtcgcctaggctggagtgcagtggcgtg

SEQ ID NO: 13462 - DNA, 32 bp, Homo sapiens
ctctatcacccaagctggagtgcagtggcacc

SEQ ID NO: 13463 - DNA, 32 bp, Homo sapiens
gaatagagaagaggtaagaagataattgtttt

SEQ ID NO: 13464 - DNA, 32 bp, Homo sapiens
ctctgtcacccaggctggagtgcagtggcacc

SEQ ID NO: 13465 - DNA, 32 bp, Homo sapiens
ctctgtcacccaggctagagtgcaatggcacc

SEQ ID NO: 13466 - DNA, 32 bp, Homo sapiens
ctccgttgcccaggctggagtacaatggtgcg

SEQ ID NO: 13467 - DNA, 32 bp, Homo sapiens
gaacctgggaggcagagattacactgacctga

SEQ ID NO: 13468 - DNA, 32 bp, Homo sapiens
gatccgtacctccaaggctcccatgggcccaa

SEQ ID NO: 13469 - DNA, 32 bp, Homo sapiens
acctctgcctcctgggttcaagcagttctctt

SEQ ID NO: 13470 - DNA, 32 bp, Homo sapiens
taagggaccctctctttttggatggcagagat

SEQ ID NO: 13471 - DNA, 32 bp, Homo sapiens
gtctcccccaaaactggctggcaccagcttca

SEQ ID NO: 13472 - DNA, 32 bp, Homo sapiens
agaaagtcacggacaagttcactgagagcgtc

SEQ ID NO: 13473 - DNA, 32 bp, Homo sapiens
tctttggccccttgctggagtcatgtgcctct

SEQ ID NO: 13474 - DNA, 32 bp, Homo sapiens
agcagagaggaaggagaaagaggaggagagag

SEQ ID NO: 13475 - DNA, 32 bp, Homo sapiens
tatgattggagtttagtttatgttggccagct

SEQ ID NO: 13476 - DNA, 28 bp, Homo sapiens
gccttccaaagtgctgggatatcaggca

SEQ ID NO: 13477 - DNA, 32 bp, Homo sapiens
tctctgccaagtgctcttgataatttcttcag

SEQ ID NO: 13478 - DNA, 32 bp, Homo sapiens
gacctgtcgctgcgcttcctggagaacgcgct

SEQ ID NO: 13479 - DNA, 32 bp, Homo sapiens
acctccacctcccggattcaagcaattcttct

SEQ ID NO: 13480 - DNA, 32 bp, Homo sapiens
gctcgcctgagtatggggtggtgtcatggagc

SEQ ID NO: 13481 - DNA, 32 bp, Homo sapiens
ggcactttttccaatttgactgatctctaaac

SEQ ID NO: 13482 - DNA, 32 bp, Homo sapiens
cttgacaaagagacgggggtgtgaactgggca

SEQ ID NO: 13483 - DNA, 32 bp, Homo sapiens
ctggacccctgctaggaggacagggtcccctc

SEQ ID NO: 13484 - DNA, 28 bp, Homo sapiens
tttattggttgaatgtgtatctatttga

SEQ ID NO: 13485 - DNA, 22 bp, Homo sapiens
tcatacctgtaatcctagcact

SEQ ID NO: 13486 - DNA, 32 bp, Homo sapiens
aatgaccatggagcggaaagaaagaaaacagc

SEQ ID NO: 13487 - DNA, 32 bp, Homo sapiens
ccctggagagcagcagggggtcttcactcctg

SEQ ID NO: 13488 - DNA, 32 bp, Homo sapiens
gacaaggagccagcagtaggatcaagtgacgc

SEQ ID NO: 13489 - DNA, 32 bp, Homo sapiens
attgggggcaggaggagtctggaacacagcct

SEQ ID NO: 13490 - DNA, 32 bp, Homo sapiens
agccagagtggaggaatgagctctgagacaca

SEQ ID NO: 13491 - DNA, 32 bp, Homo sapiens
gaactcgggaggcagaggtttcagggagccaa

SEQ ID NO: 13492 - DNA, 32 bp, Homo sapiens
gcctctgtgaccacctgctagagggagattct

SEQ ID NO: 13493 - DNA, 32 bp, Homo sapiens
agcctcctgggtagctgggattacaggcacgc

SEQ ID NO: 13494 - DNA, 32 bp, Homo sapiens
agaaaatgcaagtcaggcctggcagctagagc

SEQ ID NO: 13495 - DNA, 32 bp, Homo sapiens
cttggggttattggagcctgagcttgacctca

SEQ ID NO: 13496 - DNA, 18 bp, Homo sapiens
gggcggccattcgggcag

SEQ ID NO: 13497 - DNA, 32 bp, Homo sapiens
aagaagaggagcctcagaagaaaacaaagttc

SEQ ID NO: 13498 - DNA, 32 bp, Homo sapiens
agcctctctggtagctgggattacagggaagg

SEQ ID NO: 13499 - DNA, 32 bp, Homo sapiens
ttgaggtccccaaaggtgtatttttgggcaaa

SEQ ID NO: 13500 - DNA, 32 bp, Homo sapiens
agtaggtctgcagctatttcaacttccttccg

SEQ ID NO: 13501 - DNA, 32 bp, Homo sapiens
aaactctccagccactctcttctacgctgcct

SEQ ID NO: 13502 - DNA, 32 bp, Homo sapiens
ttgtccttagaaggagaaagacagagacacat

SEQ ID NO: 13503 - DNA, 32 bp, Homo sapiens
ttttgatggagtttcgctgttgttgcccaggc

SEQ ID NO: 13504 - DNA, 24 bp, Homo sapiens
acaggtgtgagccaccacgctggc

SEQ ID NO: 13505 - DNA, 32 bp, Homo sapiens
acctccacctcccgggttcaagcaattctcct

SEQ ID NO: 13506 - DNA, 28 bp, Homo sapiens
cccccactcgatgctgcctcatcttcct

SEQ ID NO: 13507 - DNA, 32 bp, Homo sapiens
ggagccaccacttccagttctgatcttctcat

SEQ ID NO: 13508 - DNA, 32 bp, Homo sapiens
gagctgccaggctccttttctgatctcccagc

SEQ ID NO: 13509 - DNA, 32 bp, Homo sapiens
gctgtctcacccaggctggagtgcagtggcac

SEQ ID NO: 13510 - DNA, 32 bp, Homo sapiens
ctgggtggcagaggagataaacagccatgtgc

SEQ ID NO: 13511 - DNA, 32 bp, Homo sapiens
gagaatcactgcactagatcactttgtgtttt

SEQ ID NO: 13512 - DNA, 32 bp, Homo sapiens
acatttccactgtcttccctggcagctgtgat

SEQ ID NO: 13513 - DNA, 32 bp, Homo sapiens
ctctgtcgcctaggctggagtgcagtggtgca

SEQ ID NO: 13514 - DNA, 32 bp, Homo sapiens
gggttccatttaggagctttctagaaagttga

SEQ ID NO: 13515 - DNA, 32 bp, Homo sapiens
ttagtgttcaaaacattgaaacactcttcacc

SEQ ID NO: 13516 - DNA, 32 bp, Homo sapiens
gaaaatcccagggcccttaagatatgctgtat

SEQ ID NO: 13517 - DNA, 32 bp, Homo sapiens
cacttcgggaggccgaggcaggtggaacactt

SEQ ID NO: 13518 - DNA, 32 bp, Homo sapiens
cttctctctgcaacaggagaaaacctggagct

SEQ ID NO: 13519 - DNA, 32 bp, Homo sapiens
gccttcagacaaacaggaaacttctgcagtca

SEQ ID NO: 13520 - DNA, 32 bp, Homo sapiens
gcagacagttaagagaaatgagcttgacattt

SEQ ID NO: 13521 - DNA, 30 bp, Homo sapiens
aggtgatggttatcctggaactggagatta

SEQ ID NO: 13522 - DNA, 22 bp, Homo sapiens
caggacaactggcctgcctgag

SEQ ID NO: 13523 - DNA, 32 bp, Homo sapiens
ggtggaaagagatagcaggtggtgctaattca

SEQ ID NO: 13524 - DNA, 24 bp, Homo sapiens
tggcacaatcacagctcattgcag

SEQ ID NO: 13525 - DNA, 32 bp, Homo sapiens
ttggcagcctgagagctccaaggaacaagctg

SEQ ID NO: 13526 - DNA, 32 bp, Homo sapiens
tctcagtctacctcctcttttctgcctctgaa

SEQ ID NO: 13527 - DNA, 32 bp, Homo sapiens
tcttgttgccgaggctggagtgcaatggcgca

SEQ ID NO: 13528 - DNA, 32 bp, Homo sapiens
aacagtcatatgctgaatcttctatctgtgaa

SEQ ID NO: 13529 - DNA, 32 bp, Homo sapiens
actctgttgccaggctggaatgcagtggcgtc

SEQ ID NO: 13530 - DNA, 32 bp, Homo sapiens
actctgtggcccaggctggagtgcagtggcac

SEQ ID NO: 13531 - DNA, 32 bp, Homo sapiens
atctcagggcgcgacttccggggcgacgggcg

SEQ ID NO: 13532 - DNA, 32 bp, Homo sapiens
ttgaaatggaattggcaatgtgggaaataaga

SEQ ID NO: 13533 - DNA, 32 bp, Homo sapiens
aagaagagtgttcttctggtaaagctaaaatt

SEQ ID NO: 13534 - DNA, 32 bp, Homo sapiens
actctgttgcccagggtggagtgcagtggcat

SEQ ID NO: 13535 - DNA, 32 bp, Homo sapiens
acggatggaagaggaaaacactgagaacaaca

SEQ ID NO: 13536 - DNA, 32 bp, Homo sapiens
ccagaatagaagggagagagaaaacatttcta

SEQ ID NO: 13537 - DNA, 32 bp, Homo sapiens
attcccagtctacaaaaccccacagctcctag

SEQ ID NO: 13538 - DNA, 32 bp, Homo sapiens
cagtcttctcaaggagcaataatcttggctca

SEQ ID NO: 13539 - DNA, 32 bp, Homo sapiens
aaaggaaatctgtcttctcttcccttggtttg

SEQ ID NO: 13540 - DNA, 32 bp, Homo sapiens
atttgcagcctaacttctcttttccttttaaa

SEQ ID NO: 13541 - DNA, 32 bp, Homo sapiens
tctggagcatgaggctggatgcagtggtggtg

SEQ ID NO: 13542 - DNA, 32 bp, Homo sapiens
tcctcctcagttctgtgcctgagaaccactgc

SEQ ID NO: 13543 - DNA, 32 bp, Homo sapiens
ttgagacagagtttcgctctagttgcccacac

SEQ ID NO: 13544 - DNA, 28 bp, Homo sapiens
tgatagccaagtgcttggcctggtcgac

SEQ ID NO: 13545 - DNA, 32 bp, Homo sapiens
atgataccaagtgctgaacctgagagcagccc

SEQ ID NO: 13546 - DNA, 32 bp, Homo sapiens
gttctgttgcccaggagggagtgcagtggtgc

SEQ ID NO: 13547 - DNA, 32 bp, Homo sapiens
gctgtattgcccaggctggagtgtggtggcac

SEQ ID NO: 13548 - DNA, 32 bp, Homo sapiens
aatgctaggaggcagaaggggcagagagtaaa

SEQ ID NO: 13549 - DNA, 32 bp, Homo sapiens
tatgagaaaggcactagatgactttaggattt

SEQ ID NO: 13550 - DNA, 32 bp, Homo sapiens
ggcagcaggaggcggagctcttttgcttggat

SEQ ID NO: 13551 - DNA, 32 bp, Homo sapiens
ccctctgttgccaggctagagtgcagtggcat

SEQ ID NO: 13552 - DNA, 18 bp, Homo sapiens
tgggggaggagatgggga

SEQ ID NO: 13553 - DNA, 22 bp, Homo sapiens
tcttgcctgtaatcccagcatt

SEQ ID NO: 13554 - DNA, 32 bp, Homo sapiens
accataaatttccaggatcagactaacggcta

SEQ ID NO: 13555 - DNA, 19 bp, Homo sapiens
ccggggcgccggctcagca

SEQ ID NO: 13556 - DNA, 32 bp, Homo sapiens
ccctgttccaaaacaaaattcacctcctttct

SEQ ID NO: 13557 - DNA, 32 bp, Homo sapiens
tccgcctcttcacctactgttctgcctgcctg

SEQ ID NO: 13558 - DNA, 32 bp, Homo sapiens
gactttctcaccctgcggcaggcacaacagat

SEQ ID NO: 13559 - DNA, 17 bp, Homo sapiens
gccatcaggctcccaga

SEQ ID NO: 13560 - DNA, 32 bp, Homo sapiens
tcagcactgtcgtcttcttggagggcaaactt

SEQ ID NO: 13561 - DNA, 25 bp, Homo sapiens
acaggcatgcaccaccacgcccagc

SEQ ID NO: 13562 - DNA, 25 bp, Homo sapiens
acaggcgtgcaccaccacgcccggc

SEQ ID NO: 13563 - DNA, 32 bp, Homo sapiens
tgggagttgctgctgtttacagccacagtctc

SEQ ID NO: 13564 - DNA, 32 bp, Homo sapiens
gtctgtttcccaggctggagtgtagtgataca

SEQ ID NO: 13565 - DNA, 32 bp, Homo sapiens
ctgagctgcccaggcttcacggagcggtgttg

SEQ ID NO: 13566 - DNA, 32 bp, Homo sapiens
agaagaagaagaggaggaggaggaggaggaag

SEQ ID NO: 13567 - DNA, 32 bp, Homo sapiens
acctctgcctccctggttcaagcaattctcat

SEQ ID NO: 13568 - DNA, 32 bp, Homo sapiens
acctccgcctcctgggttcaagcgattcctct

SEQ ID NO: 13569 - DNA, 32 bp, Homo sapiens
gcttccaaaagtgcccgaggcagcccttccag

SEQ ID NO: 13570 - DNA, 32 bp, Homo sapiens
ggttctagggctgggagctgggatttgaacca

SEQ ID NO: 13571 - DNA, 32 bp, Homo sapiens
ctatgtctcccaggctggagtgcagtggcaca

SEQ ID NO: 13572 - DNA, 32 bp, Homo sapiens
ctctgtcgcccaggctggagtgcactggcgca

SEQ ID NO: 13573 - DNA, 32 bp, Homo sapiens
gaaccatagaagagaggaagaaaacaaagggc

SEQ ID NO: 13574 - DNA, 32 bp, Homo sapiens
cagggttcaagcaattctcctgcctcagcctt

SEQ ID NO: 13575 - DNA, 32 bp, Homo sapiens
ctgggctcaagtgatcatcccacctcagcctc

SEQ ID NO: 13576 - DNA, 32 bp, Homo sapiens
gtctgtcacccaggttggagtgcagtggcgtg

SEQ ID NO: 13577 - DNA, 32 bp, Homo sapiens
actcgccctccagcttctgccctgcctgctgt

SEQ ID NO: 13578 - DNA, 23 bp, Homo sapiens
gcagataccacccggaggcagtg

SEQ ID NO: 13579 - DNA, 32 bp, Homo sapiens
cacttgaggttaggagtttgagaccagcctgg

SEQ ID NO: 13580 - DNA, 21 bp, Homo sapiens
accaacatggtgaaacctcgt

SEQ ID NO: 13581 - DNA, 32 bp, Homo sapiens
tatcttctgctgctgcttggagttacattttc

SEQ ID NO: 13582 - DNA, 32 bp, Homo sapiens
cgcttattgcccaggctggagtgcaatggcac

SEQ ID NO: 13583 - DNA, 32 bp, Homo sapiens
gtttcgaactctggggttcaagcaatctgccc

SEQ ID NO: 13584 - DNA, 32 bp, Homo sapiens
ctactcgggaggctgaggcaggataattgctt

SEQ ID NO: 13585 - DNA, 32 bp, Homo sapiens
caacctgggaggcagaggttgcagtgagccga

SEQ ID NO: 13586 - DNA, 32 bp, Homo sapiens
agccttagaagaggaagcaaaggcagattcag

SEQ ID NO: 13587 - DNA, 32 bp, Homo sapiens
ccaggttcaagcaattctcctgcctcaggctc

SEQ ID NO: 13588 - DNA, 32 bp, Homo sapiens
gcagtgtgacctcctgtgacccatgaatgtgc

SEQ ID NO: 13589 - DNA, 32 bp, Homo sapiens
taggaccaattaccttgaaatattttaaaatc

SEQ ID NO: 13590 - DNA, 24 bp, Homo sapiens
tggcacaatctcggcccgctgcag

SEQ ID NO: 13591 - DNA, 32 bp, Homo sapiens
tgcagatggggtctttggaaatgttagtcacc

SEQ ID NO: 13592 - DNA, 32 bp, Homo sapiens
acctccagctcctgggttcaagcaattctcat

SEQ ID NO: 13593 - DNA, 32 bp, Homo sapiens
gaacctggcaggcggaggttgcagtgagccga

SEQ ID NO: 13594 - DNA, 32 bp, Homo sapiens
catagtatcatcctgaatagtttgaatgctct

SEQ ID NO: 13595 - DNA, 32 bp, Homo sapiens
gcagcttgcccagctcttgagtacagtggtgg

SEQ ID NO: 13596 - DNA, 32 bp, Homo sapiens
tcttgttgcccaggctggaatgcagtggcacg

SEQ ID NO: 13597 - DNA, 32 bp, Homo sapiens
atctgtcacccaggctggagcgcagtggtgtg

SEQ ID NO: 13598 - DNA, 22 bp, Homo sapiens
ccttggcagcctgtcaccgccc

SEQ ID NO: 13599 - DNA, 32 bp, Homo sapiens
cgcttaagcccaggagcttaagaccagcctgg

SEQ ID NO: 13600 - DNA, 32 bp, Homo sapiens
cttctccccatagcgactcttctgcctggact

SEQ ID NO: 13601 - DNA, 32 bp, Homo sapiens
gctctgtcgcgcagggtggagtgcggtggcac

SEQ ID NO: 13602 - DNA, 32 bp, Homo sapiens
gtcccttgagttctgtgtcacattccagaggc

SEQ ID NO: 13603 - DNA, 32 bp, Homo sapiens
cgttgctcatgggctagattgggtatcacctt

SEQ ID NO: 13604 - DNA, 32 bp, Homo sapiens
tctgtcgggaggcgcagcggttaggtggaccg

SEQ ID NO: 13605 - DNA, 32 bp, Homo sapiens
cactgctcacatacttatgtgctgctagtctc

SEQ ID NO: 13606 - DNA, 28 bp, Homo sapiens
tctctcccaagtgccttgatctttgtaa

SEQ ID NO: 13607 - DNA, 32 bp, Homo sapiens
aatgccaccggccccatggacaacagcctggc

SEQ ID NO: 13608 - DNA, 32 bp, Homo sapiens
tggcatggaaggcagaggctgggtggggtggg

SEQ ID NO: 13609 - DNA, 32 bp, Homo sapiens
accctcccaagtagctgggattacaggtgccc

SEQ ID NO: 13610 - DNA, 32 bp, Homo sapiens
ctgcctccgagtagctgggactacaggtgtga

SEQ ID NO: 13611 - DNA, 32 bp, Homo sapiens
gccaccaggcacgacttcctaaacacccacag

SEQ ID NO: 13612 - DNA, 32 bp, Homo sapiens
ccagcccttgcttggtcacaggttacacagat

SEQ ID NO: 13613 - DNA, 32 bp, Homo sapiens
acaatcaacctgcactgagcactttgtgcggg

SEQ ID NO: 13614 - DNA, 32 bp, Homo sapiens
ctaggaggtctacaaatagcgactgggtagct

SEQ ID NO: 13615 - DNA, 32 bp, Homo sapiens
gaaagctgccgaagcagccactggaaagaacc

SEQ ID NO: 13616 - DNA, 23 bp, Homo sapiens
tggtgcgatctcggctcacagca

SEQ ID NO: 13617 - DNA, 23 bp, Homo sapiens
tggcgcgatctaggctcactgca

SEQ ID NO: 13618 - DNA, 32 bp, Homo sapiens
gctctgtcatccaggttggagtgcagtggcat

SEQ ID NO: 13619 - DNA, 32 bp, Homo sapiens
gttctgtcacccaggctggagtgcagtggcac

SEQ ID NO: 13620 - DNA, 32 bp, Homo sapiens
tctctgtcacccaagttggagtgcagtggccc

SEQ ID NO: 13621 - DNA, 32 bp, Homo sapiens
acggtccctttatgctaagtcagtggttctca

SEQ ID NO: 13622 - DNA, 32 bp, Homo sapiens
ccgggttcaagcaattctcctgtctcagcctc

SEQ ID NO: 13623 - DNA, 32 bp, Homo sapiens
ccgggttcaagcaactctcctgcctcagcctc

SEQ ID NO: 13624 - DNA, 32 bp, Homo sapiens
gaacccaggaggcacagattgcagtgagccaa

SEQ ID NO: 13625 - DNA, 32 bp, Homo sapiens
ttgaaaattcgcccgagctgtttatgttttta

SEQ ID NO: 13626 - DNA, 23 bp, Homo sapiens
tggcacgatctcggcttatggca

SEQ ID NO: 13627 - DNA, 32 bp, Homo sapiens
cttggactcctctctttgctgaagagacccaa

SEQ ID NO: 13628 - DNA, 32 bp, Homo sapiens
gattatacttcatgagtcttagcaatatggga

SEQ ID NO: 13629 - DNA, 32 bp, Homo sapiens
aggctttgcaaactgtgaagtgcagtgcctac

SEQ ID NO: 13630 - DNA, 28 bp, Homo sapiens
acattcccaagtgcctgtccttattgga

SEQ ID NO: 13631 - DNA, 32 bp, Homo sapiens
gaacctggaaggcaggggttgcagtgacctga

SEQ ID NO: 13632 - DNA, 32 bp, Homo sapiens
gaacccaggagatagaggttgcaatgagccaa

SEQ ID NO: 13633 - DNA, 32 bp, Homo sapiens
agcttcctaagtagctgggattacaggcgtgc

SEQ ID NO: 13634 - DNA, 32 bp, Homo sapiens
ccagatactgaacaagttagtgcaatgaagta

SEQ ID NO: 13635 - DNA, 32 bp, Homo sapiens
gctttgacttcctgggctcaagcaatcctccc

SEQ ID NO: 13636 - DNA, 32 bp, Homo sapiens
ccttcccagtttctccccaacctccccttttc

SEQ ID NO: 13637 - DNA, 32 bp, Homo sapiens
gaggcggggagaggagaggagagaagagccgc

SEQ ID NO: 13638 - DNA, 32 bp, Homo sapiens
agcctcccaagtagctgggattacaggtgtgt

SEQ ID NO: 13639 - DNA, 32 bp, Homo sapiens
gctccagcctgaggcttccagaagtgccctac

SEQ ID NO: 13640 - DNA, 32 bp, Homo sapiens
ccttcttctgccgcttctggtgctgcttgtgt

SEQ ID NO: 13641 - DNA, 32 bp, Homo sapiens
ctccatcatcttcttccgagatgaccgctact

SEQ ID NO: 13642 - DNA, 32 bp, Homo sapiens
tggttccaagtctttgctattgtaaatagtgc

SEQ ID NO: 13643 - DNA, 32 bp, Homo sapiens
cccgtcgcgctgctgctgcggcgctccaagtt

SEQ ID NO: 13644 - DNA, 32 bp, Homo sapiens
gaggctcatccctcagtggcaacagaaacagg

SEQ ID NO: 13645 - DNA, 32 bp, Homo sapiens
acgagcagctccaggctggagttctggttctt

SEQ ID NO: 13646 - DNA, 32 bp, Homo sapiens
gttgtgtcacccaggttagagtgtagtggcgc

SEQ ID NO: 13647 - DNA, 32 bp, Homo sapiens
cccatcctggctctgtcatttacttacagaaa

SEQ ID NO: 13648 - DNA, 28 bp, Homo sapiens
aactgtcgacgtgctgccacgtctgttg

SEQ ID NO: 13649 - DNA, 32 bp, Homo sapiens
gaacccgggaagcggaggttgcagggagccga

SEQ ID NO: 13650 - DNA, 32 bp, Homo sapiens
cactgggaacaacaggttgccttagaagcttt

SEQ ID NO: 13651 - DNA, 32 bp, Homo sapiens
aatcatcgttttccctggcaggtggtacagcc

SEQ ID NO: 13652 - DNA, 32 bp, Homo sapiens
ctctgctccccaggcttgagtgagtgtgtgcc

SEQ ID NO: 13653 - DNA, 32 bp, Homo sapiens
agcccctgaccagcctcctcccatgactggtg

SEQ ID NO: 13654 - DNA, 32 bp, Homo sapiens
tgttctctgcatcccctcaccaccttcctttg

SEQ ID NO: 13655 - DNA, 32 bp, Homo sapiens
gtgccctcggcagcttcggtccagcctgcatc

SEQ ID NO: 13656 - DNA, 17 bp, Homo sapiens
cctctgcctgccaggta

SEQ ID NO: 13657 - DNA, 28 bp, Homo sapiens
gagccctcagtgccagcctcatcactgt

SEQ ID NO: 13658 - DNA, 32 bp, Homo sapiens
ctgaggtcaggcaatctgcccacctcagcctc

SEQ ID NO: 13659 - DNA, 32 bp, Homo sapiens
tgcactcccatgttcactgcagtattatttgc

SEQ ID NO: 13660 - DNA, 32 bp, Homo sapiens
gcctgtaataccatgtcttcccatgaggggtc

SEQ ID NO: 13661 - DNA, 22 bp, Homo sapiens
cctccatctggggatggagaat

SEQ ID NO: 13662 - DNA, 23 bp, Homo sapiens
aatgaggaaactgaggcttggtg

SEQ ID NO: 13663 - DNA, 32 bp, Homo sapiens
atgggctgctgcttagcttgcaccttgtcaca

SEQ ID NO: 13664 - DNA, 32 bp, Homo sapiens
gaacccgggaggcggaggttgccgtgagtcga

SEQ ID NO: 13665 - DNA, 32 bp, Homo sapiens
ctgattagaaggggaggttcaaactgtcaatg

SEQ ID NO: 13666 - DNA, 32 bp, Homo sapiens
acctccacctcccgggttcaagtgattctcct

SEQ ID NO: 13667 - DNA, 32 bp, Homo sapiens
gaacccgggaggtgcaggttgcagtgagccaa

SEQ ID NO: 13668 - DNA, 32 bp, Homo sapiens
gaacccaggaggtgcaggttgcagtgagccga

SEQ ID NO: 13669 - DNA, 32 bp, Homo sapiens
agcctcctgagtcgctgggattactgagattg

SEQ ID NO: 13670 - DNA, 32 bp, Homo sapiens
aaaacaacaacaacaacaaaaaccctattcct

SEQ ID NO: 13671 - DNA, 32 bp, Homo sapiens
gccgtgctcgaagcgttcctggagcccaagct

SEQ ID NO: 13672 - DNA, 32 bp, Homo sapiens
gaaattagaagaggcaagaaacaactccccac

SEQ ID NO: 13673 - DNA, 32 bp, Homo sapiens
ctgggctcaagcagtcctcccaccttggcctc

SEQ ID NO: 13674 - DNA, 32 bp, Homo sapiens
tccccagtgtctgggagcatctggcttcctct

SEQ ID NO: 13675 - DNA, 32 bp, Homo sapiens
ccccagcccagatcctggagggctttgggctt

SEQ ID NO: 13676 - DNA, 32 bp, Homo sapiens
tcactctctgcaggtttttgcctacactttga

SEQ ID NO: 13677 - DNA, 32 bp, Homo sapiens
gggtcataaagaggaggagaaacagggtgagt

SEQ ID NO: 13678 - DNA, 32 bp, Homo sapiens
tcctaccatcccaggaggcaggcacagccagg

SEQ ID NO: 13679 - DNA, 32 bp, Homo sapiens
ggatcccgtgcgcctggagacagggtccagat

SEQ ID NO: 13680 - DNA, 32 bp, Homo sapiens
tgcttcccttgggacaagtcccagaagaacta

SEQ ID NO: 13681 - DNA, 23 bp, Homo sapiens
tggcatgatctcggctcactaca

SEQ ID NO: 13682 - DNA, 23 bp, Homo sapiens
tggcgtgatctcggctcactgca

SEQ ID NO: 13683 - DNA, 23 bp, Homo sapiens
tggcatgatctcagctcactgca

SEQ ID NO: 13684 - DNA, 32 bp, Homo sapiens
ttgaatttgcccaggtaggcgtgagagtgtgg

SEQ ID NO: 13685 - DNA, 32 bp, Homo sapiens
cccctgttgcccaggctggagtgcagtgggat

SEQ ID NO: 13686 - DNA, 32 bp, Homo sapiens
attctgtcacccaggccggagtgcagtggtgt

SEQ ID NO: 13687 - DNA, 32 bp, Homo sapiens
gaacctgggaggcagagattgcagtgagccaa

SEQ ID NO: 13688 - DNA, 32 bp, Homo sapiens
tgccgtcatccaggctggacagttcagtgatt

SEQ ID NO: 13689 - DNA, 32 bp, Homo sapiens
gaacctgggaggcagaggttgcggtaagccga

SEQ ID NO: 13690 - DNA, 32 bp, Homo sapiens
gaacccaggaggcagagattgcagtgagctga

SEQ ID NO: 13691 - DNA, 32 bp, Homo sapiens
gaacctgggaggcagaggttgcagtaagccaa

SEQ ID NO: 13692 - DNA, 32 bp, Homo sapiens
agtctcctgagtagctgggactgcaggcatgc

SEQ ID NO: 13693 - DNA, 32 bp, Homo sapiens
cactgttgcccaggctggagtgcagtgacgcg

SEQ ID NO: 13694 - DNA, 32 bp, Homo sapiens
ggcccctgcccagggcttgggtctggtgagct

SEQ ID NO: 13695 - DNA, 32 bp, Homo sapiens
cttggctgaagaggaaataaaaacagaacagg

SEQ ID NO: 13696 - DNA, 32 bp, Homo sapiens
gtgtgttcagagcttgtctccacctcacggct

SEQ ID NO: 13697 - DNA, 32 bp, Homo sapiens
acgggttcaagcaattctcctgcctcagcctc

SEQ ID NO: 13698 - DNA, 32 bp, Homo sapiens
ctaggtgatcagcttgaaattcagctaaccga

SEQ ID NO: 13699 - DNA, 32 bp, Homo sapiens
ttgagatggagttttgctcttgcactccatcc

SEQ ID NO: 13700 - DNA, 32 bp, Homo sapiens
ctaggaactcaaggagtcagcctagaccccac

SEQ ID NO: 13701 - DNA, 32 bp, Homo sapiens
cggctggaagggtaggcttcattcaccgctcg

SEQ ID NO: 13702 - DNA, 32 bp, Homo sapiens
cctgttgctcattaagctgagtgcagacgtcc

SEQ ID NO: 13703 - DNA, 32 bp, Homo sapiens
cctcacttgctcaaaaacaactacctggagaa

SEQ ID NO: 13704 - DNA, 32 bp, Homo sapiens
gagcagccatcaggctggaggtgacgatgagt

SEQ ID NO: 13705 - DNA, 32 bp, Homo sapiens
tcttgttgcccaggcccgagtgcagtggtgcg

SEQ ID NO: 13706 - DNA, 32 bp, Homo sapiens
aattcctctaccagaactaagcactttgttaa

SEQ ID NO: 13707 - DNA, 32 bp, Homo sapiens
ggctcacacctgtcattccagcactttgagag

SEQ ID NO: 13708 - DNA, 32 bp, Homo sapiens
tattcaattagcaaaggagaaactttctcaat

SEQ ID NO: 13709 - DNA, 21 bp, Homo sapiens
cagggtgcccctgtccagccc

SEQ ID NO: 13710 - DNA, 24 bp, Homo sapiens
tcacgcctgtaatcacagtatttt

SEQ ID NO: 13711 - DNA, 32 bp, Homo sapiens
aatactttaagaggagtggaaggaacacaaac

SEQ ID NO: 13712 - DNA, 32 bp, Homo sapiens
ctactcgggaggctgaggtgggaggatcgctg

SEQ ID NO: 13713 - DNA, 32 bp, Homo sapiens
gtttccgcccagagctggagtctcccagctgc

SEQ ID NO: 13714 - DNA, 32 bp, Homo sapiens
agcctctggagtagctgggattacaggcacgc

SEQ ID NO: 13715 - DNA, 32 bp, Homo sapiens
ggtcccctgaagtgctgggattacaggtgtga

SEQ ID NO: 13716 - DNA, 32 bp, Homo sapiens
ccttcttccccaggctgggagtgggtgagacg

SEQ ID NO: 13717 - DNA, 32 bp, Homo sapiens
gagactagaagaggggagcagaaagggacctt

SEQ ID NO: 13718 - DNA, 32 bp, Homo sapiens
ccttgaagaagaggaagaggaaagaaagacaa

SEQ ID NO: 13719 - DNA, 32 bp, Homo sapiens
cagtttcacagtagctgggatgcatggatgac

SEQ ID NO: 13720 - DNA, 21 bp, Homo sapiens
caggaaaggaggttccagccc

SEQ ID NO: 13721 - DNA, 32 bp, Homo sapiens
aaactacctaaccttggctgtgggccgataat

SEQ ID NO: 13722 - DNA, 23 bp, Homo sapiens
catgcctataatcccaatacttt

SEQ ID NO: 13723 - DNA, 32 bp, Homo sapiens
gctctctcacccaggcctgaagtgcagtggca

SEQ ID NO: 13724 - DNA, 25 bp, Homo sapiens
cagacgtggtaccagacaccagagc

SEQ ID NO: 13725 - DNA, 32 bp, Homo sapiens
tatgatgaggcttttgctatggctaatgatcc

SEQ ID NO: 13726 - DNA, 32 bp, Homo sapiens
cagtggggaaggcagaggagtaactgtgggga

SEQ ID NO: 13727 - DNA, 32 bp, Homo sapiens
gaggagccctccattccaattgtccacccctt

SEQ ID NO: 13728 - DNA, 32 bp, Homo sapiens
aacttgccctatttgcaaaagcacttttgtag

SEQ ID NO: 13729 - DNA, 32 bp, Homo sapiens
ggagtgtgcccaggtcactgctatggccttcg

SEQ ID NO: 13730 - DNA, 32 bp, Homo sapiens
ggtcagaagtaccaggtgccccatgaagtgct

SEQ ID NO: 13731 - DNA, 32 bp, Homo sapiens
agtctgtctacctttagccaggcacaggacag

SEQ ID NO: 13732 - DNA, 23 bp, Homo sapiens
tgagcattgtggtagttgttctt

SEQ ID NO: 13733 - DNA, 23 bp, Homo sapiens
gatggggaggctggggcctgggg

SEQ ID NO: 13734 - DNA, 32 bp, Homo sapiens
tggagtcttgttctgtcacccaggctggggtg

SEQ ID NO: 13735 - DNA, 32 bp, Homo sapiens
cttaaaattacttggctttttccaaatgcttc

SEQ ID NO: 13736 - DNA, 32 bp, Homo sapiens
aggggagccccaggaaggcagcattcataagc

SEQ ID NO: 13737 - DNA, 32 bp, Homo sapiens
agcctcctgagtagctgggattacaagggcac

SEQ ID NO: 13738 - DNA, 32 bp, Homo sapiens
cgcccccagcaccacggaaactacctacatgc

SEQ ID NO: 13739 - DNA, 32 bp, Homo sapiens
ccacaggcaggaggagaagcatgaagagaaaa

SEQ ID NO: 13740 - DNA, 32 bp, Homo sapiens
agcctcttgagtagctgggattacaggcgccc

SEQ ID NO: 13741 - DNA, 32 bp, Homo sapiens
agcctcccgagtagttgggattacaggcgcct

SEQ ID NO: 13742 - DNA, 32 bp, Homo sapiens
gtgtcctcccagggagcttctcttctcaacag

SEQ ID NO: 13743 - DNA, 32 bp, Homo sapiens
aaaaagatctctgcctctcttctctctgcctc

SEQ ID NO: 13744 - DNA, 32 bp, Homo sapiens
tacaaaaggtttaggaaaagaaaacaatggtg

SEQ ID NO: 13745 - DNA, 32 bp, Homo sapiens
ggttgtcacttaagtttggagtgcagtggcat

SEQ ID NO: 13746 - DNA, 32 bp, Homo sapiens
caaagtcatccctctgttcacagagatggatg

SEQ ID NO: 13747 - DNA, 32 bp, Homo sapiens
ctttgtaacccaggctggaatgcaatggcatg

SEQ ID NO: 13748 - DNA, 32 bp, Homo sapiens
atgctacaactactatttttagcaatgttttt

SEQ ID NO: 13749 - DNA, 32 bp, Homo sapiens
agtccttgcccaggctggagtgcagtggcgcg

SEQ ID NO: 13750 - DNA, 28 bp, Homo sapiens
catctagcgggtgctgcctgcatctctt

SEQ ID NO: 13751 - DNA, 32 bp, Homo sapiens
accagcccccggcagaggctgaggtggcagtg

SEQ ID NO: 13752 - DNA, 24 bp, Homo sapiens
ctgctgcccaggctggagtacagt

SEQ ID NO: 13753 - DNA, 32 bp, Homo sapiens
acctatagcctttgtgctgttctgccttgcct

SEQ ID NO: 13754 - DNA, 32 bp, Homo sapiens
aacctcccaagtagctgggattacagaaagcc

SEQ ID NO: 13755 - DNA, 32 bp, Homo sapiens
gctctgttgcccagcctggagtgcaatggcac

SEQ ID NO: 13756 - DNA, 21 bp, Homo sapiens
ctgaccaacatggtgaggccc

SEQ ID NO: 13757 - DNA, 32 bp, Homo sapiens
ccctaatgcgcaggctggccctgccctggttt

SEQ ID NO: 13758 - DNA, 32 bp, Homo sapiens
gaacccgggaggcagaggctgcagtgagccga

SEQ ID NO: 13759 - DNA, 32 bp, Homo sapiens
actctgtcaccaggctagagtgcagtggcacg

SEQ ID NO: 13760 - DNA, 32 bp, Homo sapiens
gctccatcaccaggctggagtgcagtggtgcg

SEQ ID NO: 13761 - DNA, 28 bp, Homo sapiens
ggctgccccagtgctgccacagtcccac

SEQ ID NO: 13762 - DNA, 32 bp, Homo sapiens
atgaactacggtgtgttaaacaacagcagtgg

SEQ ID NO: 13763 - DNA, 32 bp, Homo sapiens
tgtttttgggggaacagggagcattcacaggg

SEQ ID NO: 13764 - DNA, 32 bp, Homo sapiens
aaacactgggctgtttgcacagctccaactgt

SEQ ID NO: 13765 - DNA, 32 bp, Homo sapiens
agcctcccaagtagctgggattacaggtgcag

SEQ ID NO: 13766 - DNA, 32 bp, Homo sapiens
ttaaactcagttctgcatccaacttgagaaga

SEQ ID NO: 13767 - DNA, 32 bp, Homo sapiens
gtaagctcccttctgtcattttcattgattta

SEQ ID NO: 13768 - DNA, 32 bp, Homo sapiens
acagccaagccttttgaagactaattagaaaa

SEQ ID NO: 13769 - DNA, 28 bp, Homo sapiens
ggccgccagaaagatgcctcatcctcga

SEQ ID NO: 13770 - DNA, 28 bp, Homo sapiens
cgcttcccccaagctgcctcatggcccg

SEQ ID NO: 13771 - DNA, 32 bp, Homo sapiens
gggctcccagttcaggatgggccacagggcgt

SEQ ID NO: 13772 - DNA, 32 bp, Homo sapiens
acttctgtgctgctgcttctcctccatcttgc

SEQ ID NO: 13773 - DNA, 31 bp, Homo sapiens
gcgacgactacgaccactaggagagcggacg

SEQ ID NO: 13774 - DNA, 32 bp, Homo sapiens
atgggaacgaggcagaggaaatagagaaattt

SEQ ID NO: 13775 - DNA, 32 bp, Homo sapiens
actgcagcctccacctcctgggctctccagcg

SEQ ID NO: 13776 - DNA, 23 bp, Homo sapiens
ctcgggagcctgaggcaggagaa

SEQ ID NO: 13777 - DNA, 21 bp, Homo sapiens
tgcgggaaagagggaggggga

SEQ ID NO: 13778 - DNA, 32 bp, Homo sapiens
ctctgttgcccaagctggagtacagtagtgca

SEQ ID NO: 13779 - DNA, 32 bp, Homo sapiens
actctgtggcccaggctggagtgcagtggtgc

SEQ ID NO: 13780 - DNA, 32 bp, Homo sapiens
tcagggcgcaggagggaatgagctgtggattt

SEQ ID NO: 13781 - DNA, 32 bp, Homo sapiens
agaaaagaaaagaaaagaaagaaaggaattag

SEQ ID NO: 13782 - DNA, 32 bp, Homo sapiens
aagccgcccagtgccctgagcgtctccatggc

SEQ ID NO: 13783 - DNA, 32 bp, Homo sapiens
aggtagtgactgagatttggtgatctggctga

SEQ ID NO: 13784 - DNA, 32 bp, Homo sapiens
ggcccgaggacccactgtgagcactccaccca

SEQ ID NO: 13785 - DNA, 32 bp, Homo sapiens
agcctcctgagcagctgggattacaggcgctg

SEQ ID NO: 13786 - DNA, 28 bp, Homo sapiens
ctggcgcctcctgctgcctcctccatac

SEQ ID NO: 13787 - DNA, 32 bp, Homo sapiens
ccttcatgcctgtaatcccagcactttgggag

SEQ ID NO: 13788 - DNA, 32 bp, Homo sapiens
tgaacatgctgagcagttgagcacttttccat

SEQ ID NO: 13789 - DNA, 32 bp, Homo sapiens
ggcttatgcctgtaattgcagcacttttagag

SEQ ID NO: 13790 - DNA, 32 bp, Homo sapiens
ctagttgcagaactggaccaggatgaaaggac

SEQ ID NO: 13791 - DNA, 20 bp, Homo sapiens
gccaacaagaccatccagaa

SEQ ID NO: 13792 - DNA, 23 bp, Homo sapiens
tcacgcctgtaatcccagcattt

SEQ ID NO: 13793 - DNA, 32 bp, Homo sapiens
actctgttgcccaggctggagtgcagtggcgt

SEQ ID NO: 13794 - DNA, 32 bp, Homo sapiens
tccccctcccccagctcagaccacagaggtgg

SEQ ID NO: 13795 - DNA, 32 bp, Homo sapiens
gaaactgtatttttccttttgttttcatttga

SEQ ID NO: 13796 - DNA, 32 bp, Homo sapiens
actctgtcacccaggctggagtgcggtggcgc

SEQ ID NO: 13797 - DNA, 32 bp, Homo sapiens
gctctgtcgcccaggctggagtgcggtggcgc

SEQ ID NO: 13798 - DNA, 32 bp, Homo sapiens
gctgtcttgcccaggctggagttcaggggcta

SEQ ID NO: 13799 - DNA, 32 bp, Homo sapiens
gctctgtcacccagactggagtgcagtggcac

SEQ ID NO: 13800 - DNA, 32 bp, Homo sapiens
gctctgtcacccaggctggagtgcagtggcgc

SEQ ID NO: 13801 - DNA, 32 bp, Homo sapiens
actctgtcgcccaggctggagtgcagtggcgc

SEQ ID NO: 13802 - DNA, 32 bp, Homo sapiens
gaaagcttgtcactgattctttgcttcaggag

SEQ ID NO: 13803 - DNA, 32 bp, Homo sapiens
ctctgtcgcccaggctggagtgcagaggtgcg

SEQ ID NO: 13804 - DNA, 32 bp, Homo sapiens
cactgtcgcccaggctggagtgcggtggtgca

SEQ ID NO: 13805 - DNA, 32 bp, Homo sapiens
ctgccaccagaggtgaggagtctcttgtcact

SEQ ID NO: 13806 - DNA, 32 bp, Homo sapiens
gcctgtttcatcacgtatgtgctgctacctgt

SEQ ID NO: 13807 - DNA, 32 bp, Homo sapiens
ctcttgctgcccaggctggagtgcagtggctc

SEQ ID NO: 13808 - DNA, 32 bp, Homo sapiens
caaaagtttaatcagaggaaattctttcccag

SEQ ID NO: 13809 - DNA, 32 bp, Homo sapiens
ctcctgagcaccccatgggattacgctgtgtg

SEQ ID NO: 13810 - DNA, 28 bp, Homo sapiens
tgtcttccaagtgccatccatcatcagt

SEQ ID NO: 13811 - DNA, 32 bp, Homo sapiens
tccttagcctccattcagcctcaggtcttttg

SEQ ID NO: 13812 - DNA, 32 bp, Homo sapiens
actcgttgcccaggctggagtgtagaggcgag

SEQ ID NO: 13813 - DNA, 32 bp, Homo sapiens
ctaagacaccgggacctcctggaagccaaaaa

SEQ ID NO: 13814 - DNA, 32 bp, Homo sapiens
acatccgcctctggggttcaagtgattctcct

SEQ ID NO: 13815 - DNA, 32 bp, Homo sapiens
ccctaacaggaaatttggcaatggggtctggg

SEQ ID NO: 13816 - DNA, 32 bp, Homo sapiens
agcttcctgagtagctgggactacaggagcgc

SEQ ID NO: 13817 - DNA, 32 bp, Homo sapiens
cacagtgatagagaattgctgtggagagttat

SEQ ID NO: 13818 - DNA, 24 bp, Homo sapiens
tcaaacctgtaatcccagcacttt

SEQ ID NO: 13819 - DNA, 32 bp, Homo sapiens
agtgagacaagcaatttctcccttctgagtta

SEQ ID NO: 13820 - DNA, 32 bp, Homo sapiens
tgtttatcaagcaatgctcagcttgaagaata

SEQ ID NO: 13821 - DNA, 21 bp, Homo sapiens
ggccgtctcagttcactgcag

SEQ ID NO: 13822 - DNA, 32 bp, Homo sapiens
ttattcagtaggaactctcttctgcctggttt

SEQ ID NO: 13823 - DNA, 32 bp, Homo sapiens
aaagctactaattgtctcagtgtaagttttaa

SEQ ID NO: 13824 - DNA, 24 bp, Homo sapiens
ctgccccctctctctgtgcaggtg

SEQ ID NO: 13825 - DNA, 32 bp, Homo sapiens
taaatcacattgggttattatataatcatttc

SEQ ID NO: 13826 - DNA, 32 bp, Homo sapiens
aagggcagccctccttaccactgtggaagtcc

SEQ ID NO: 13827 - DNA, 32 bp, Homo sapiens
acctccgcctcctgggttcaggcgattctcct

SEQ ID NO: 13828 - DNA, 32 bp, Homo sapiens
taaaccccattatacttccactggttatctcc

SEQ ID NO: 13829 - DNA, 32 bp, Homo sapiens
ctctcttgcccagactggaatacagtggtgtg

SEQ ID NO: 13830 - DNA, 32 bp, Homo sapiens
ttctgttgcctgggctggagtgcagtggcatg

SEQ ID NO: 13831 - DNA, 32 bp, Homo sapiens
ctctgtcgcccacgttggagtgcagtgatgtg

SEQ ID NO: 13832 - DNA, 23 bp, Homo sapiens
tcacgcctgtaatcctagcactt

SEQ ID NO: 13833 - DNA, 23 bp, Homo sapiens
cacacctgtaatcccagcagttt

SEQ ID NO: 13834 - DNA, 32 bp, Homo sapiens
agcctcctgagtagctgggactacatgcgcac

SEQ ID NO: 13835 - DNA, 32 bp, Homo sapiens
taatcatcaggtttactcagtgaaatcatatt

SEQ ID NO: 13836 - DNA, 32 bp, Homo sapiens
tgagccattcaaggcaagcaccacctttgcta

SEQ ID NO: 13837 - DNA, 32 bp, Homo sapiens
tggctcttctagctgactcttctggttgggct

SEQ ID NO: 13838 - DNA, 32 bp, Homo sapiens
cactctgttgctaggctggagtgcagtggcac

SEQ ID NO: 13839 - DNA, 32 bp, Homo sapiens
cttctgtggcccaggctggagtgcagtggctg

SEQ ID NO: 13840 - DNA, 32 bp, Homo sapiens
ggggaggatacttgggttgatttatccattat

SEQ ID NO: 13841 - DNA, 32 bp, Homo sapiens
catggatagtctttaatctctgatctttttgg

SEQ ID NO: 13842 - DNA, 32 bp, Homo sapiens
tagtgatgttgtttgggagagtgcagtagtaa

SEQ ID NO: 13843 - DNA, 32 bp, Homo sapiens
ctctgttgcccaggctggaatgcagtgatacg

SEQ ID NO: 13844 - DNA, 32 bp, Homo sapiens
cccatgcgtgccgcctgctcctcactggagga

SEQ ID NO: 13845 - DNA, 32 bp, Homo sapiens
ggaggaaatgttcattcagtggtagctatttc

SEQ ID NO: 13846 - DNA, 32 bp, Homo sapiens
caaaaatgaagaggaaaacaaacaggtggaga

SEQ ID NO: 13847 - DNA, 32 bp, Homo sapiens
agataaaggggatgagaaagaacagagctcca

SEQ ID NO: 13848 - DNA, 32 bp, Homo sapiens
ctctgttgcccaggctggagtgtagtggtatg

SEQ ID NO: 13849 - DNA, 32 bp, Homo sapiens
agcagcctcctctcttcctgcctgagcaccgc

SEQ ID NO: 13850 - DNA, 32 bp, Homo sapiens
cttcaacctgcccttgaaccggggtctggagc

SEQ ID NO: 13851 - DNA, 32 bp, Homo sapiens
ctctgtcgcccaggctggagtacagtggtgtg

SEQ ID NO: 13852 - DNA, 32 bp, Homo sapiens
atggctgagagccaggcttccttcctggtctc

SEQ ID NO: 13853 - DNA, 32 bp, Homo sapiens
gaacctgggaagcagaggttgcagtgagccga

SEQ ID NO: 13854 - DNA, 32 bp, Homo sapiens
tcaggtcaggccagggcagtgctgctgcagag

SEQ ID NO: 13855 - DNA, 32 bp, Homo sapiens
ggacctgccacaggctgggctcttgtgctaga

SEQ ID NO: 13856 - DNA, 32 bp, Homo sapiens
gcagggccaagtgcccatgagcacagccccag

SEQ ID NO: 13857 - DNA, 32 bp, Homo sapiens
gaacccgggaagcagaggttgcagtgagctga

SEQ ID NO: 13858 - DNA, 32 bp, Homo sapiens
gagcctgggaggcagaggttgcagtgagccga

SEQ ID NO: 13859 - DNA, 32 bp, Homo sapiens
catcagttgcttttactcagtgttttcaaata

SEQ ID NO: 13860 - DNA, 32 bp, Homo sapiens
cgcctccatgtttcagcatctatgtcatgggc

SEQ ID NO: 13861 - DNA, 32 bp, Homo sapiens
ttggatttggaaggcttgcaatgtggttgact

SEQ ID NO: 13862 - DNA, 23 bp, Homo sapiens
tggcatgatctcggctcactgca

SEQ ID NO: 13863 - DNA, 23 bp, Homo sapiens
tggcgtgatctcagctcactgca

SEQ ID NO: 13864 - DNA, 32 bp, Homo sapiens
tgccctgccctctcagcttgtgagacaacaca

SEQ ID NO: 13865 - DNA, 32 bp, Homo sapiens
gatagcacagttctgtccagagaaggaaggcg

SEQ ID NO: 13866 - DNA, 32 bp, Homo sapiens
tcctaagagccaggcatggtggctcatgcctg

SEQ ID NO: 13867 - DNA, 23 bp, Homo sapiens
tggcgtgatctcggctcactaca

SEQ ID NO: 13868 - DNA, 32 bp, Homo sapiens
gctctgtctcccaggctggagtgcagtggcgt

SEQ ID NO: 13869 - DNA, 32 bp, Homo sapiens
gctctgtttcccaggctggagtgcagtggcgc

SEQ ID NO: 13870 - DNA, 32 bp, Homo sapiens
tctctgttgcccaggctggagtgcagtggcgc

SEQ ID NO: 13871 - DNA, 32 bp, Homo sapiens
gtatctgcctccattttcctgagctcaaaaag

SEQ ID NO: 13872 - DNA, 32 bp, Homo sapiens
gctctgttgtccaggctggagtgcaatggcag

SEQ ID NO: 13873 - DNA, 32 bp, Homo sapiens
ccctccgcctctcgggttcaagcaattctcct

SEQ ID NO: 13874 - DNA, 32 bp, Homo sapiens
ctgccccaggcgggctagagtgcagtggcatg

SEQ ID NO: 13875 - DNA, 32 bp, Homo sapiens
ctggcccatggcttcctactggcagctccagg

SEQ ID NO: 13876 - DNA, 32 bp, Homo sapiens
cagcaaggtaatccttgatggctggatctttt

SEQ ID NO: 13877 - DNA, 32 bp, Homo sapiens
gtctcctgtcttaggcgtcccacgccgcgtgc

SEQ ID NO: 13878 - DNA, 32 bp, Homo sapiens
tgagttattggtatgaccctgtggaaacacac

SEQ ID NO: 13879 - DNA, 32 bp, Homo sapiens
gagacctcctgccgggcaggtcactgtgctga

SEQ ID NO: 13880 - DNA, 32 bp, Homo sapiens
ctgggctcaaatgatcctcccacctcagcctc

SEQ ID NO: 13881 - DNA, 32 bp, Homo sapiens
ctaggctcaagtgatcctcccacctcagcctc

SEQ ID NO: 13882 - DNA, 32 bp, Homo sapiens
aaccatgggctgctgctgtcactccctctcca

SEQ ID NO: 13883 - DNA, 32 bp, Homo sapiens
caattttctgcagcctctttttgcctgagcaa

SEQ ID NO: 13884 - DNA, 32 bp, Homo sapiens
gcggcagaaattctccccctactgggccagct

SEQ ID NO: 13885 - DNA, 32 bp, Homo sapiens
cctctgtcacccaggctggagtgcagtggtga

SEQ ID NO: 13886 - DNA, 32 bp, Homo sapiens
tctctgtcacccaggctggcgtgcaatggcgc

SEQ ID NO: 13887 - DNA, 32 bp, Homo sapiens
gtctgcaggaattggcttatttctgtatgcca

SEQ ID NO: 13888 - DNA, 32 bp, Homo sapiens
ccatctgcgtgacctggatgtgagatgtggag

SEQ ID NO: 13889 - DNA, 32 bp, Homo sapiens
acccccaatatttttggactggcagactcaag

SEQ ID NO: 13890 - DNA, 32 bp, Homo sapiens
tgcttgaaagagactgctctatttattctgtg

SEQ ID NO: 13891 - DNA, 32 bp, Homo sapiens
gcaccctctgcagccccactcctgggccttct

SEQ ID NO: 13892 - DNA, 32 bp, Homo sapiens
acctccacttcttgggttcaagtgattctcct

SEQ ID NO: 13893 - DNA, 32 bp, Homo sapiens
gtacccaggaggtggaggttgcagtgagccga

SEQ ID NO: 13894 - DNA, 32 bp, Homo sapiens
tcaatgttgcccaggctggagtgcagtggcgt

SEQ ID NO: 13895 - DNA, 32 bp, Homo sapiens
atacatgatacttgggtagctcaacattctta

SEQ ID NO: 13896 - DNA, 23 bp, Homo sapiens
cagggctaccctctgtccagccc

SEQ ID NO: 13897 - DNA, 32 bp, Homo sapiens
tagagctgtatgaggccgggtgcagtggctca

SEQ ID NO: 13898 - DNA, 32 bp, Homo sapiens
actctgttgcctaggctggaggacagtggcac

SEQ ID NO: 13899 - DNA, 32 bp, Homo sapiens
gcctccacttcccaggttcaagtgattctcct

SEQ ID NO: 13900 - DNA, 32 bp, Homo sapiens
gtctcaaactcctgacctcaagcaatttgccc

SEQ ID NO: 13901 - DNA, 28 bp, Homo sapiens
ggggctgcaagtgctacctcgcgcttgt

SEQ ID NO: 13902 - DNA, 32 bp, Homo sapiens
ttctgctcatctctccccatttctttcttccc

SEQ ID NO: 13903 - DNA, 32 bp, Homo sapiens
ggtctcctgagtagctgggactacaggtgcat

SEQ ID NO: 13904 - DNA, 32 bp, Homo sapiens
gtctgttgcccaggctggaatgcagtggtgtg

SEQ ID NO: 13905 - DNA, 32 bp, Homo sapiens
gatctgttgcccaggctggagtgcagtggagc

SEQ ID NO: 13906 - DNA, 32 bp, Homo sapiens
gtgctccggcccaggcgggggagtcagtgccc

SEQ ID NO: 13907 - DNA, 32 bp, Homo sapiens
gcccgcccagttctctgagcgtgcggcggacg

SEQ ID NO: 13908 - DNA, 32 bp, Homo sapiens
gaatccgggaggcggaggttgcagtgaaccga

SEQ ID NO: 13909 - DNA, 32 bp, Homo sapiens
ttcacagtgtcaggctggacgccgtgatttca

SEQ ID NO: 13910 - DNA, 32 bp, Homo sapiens
gccttgacttcctgggctcaagtgatcatccc

SEQ ID NO: 13911 - DNA, 32 bp, Homo sapiens
tttcacccaagtgccagtcaacagagtacatg

SEQ ID NO: 13912 - DNA, 32 bp, Homo sapiens
gaatccaggaggcggaggttgcagtgaaccaa

SEQ ID NO: 13913 - DNA, 24 bp, Homo sapiens
ctgtctcccaggctagagtgcaat

SEQ ID NO: 13914 - DNA, 32 bp, Homo sapiens
agcctcccaagtagctgggattacaggcgcat

SEQ ID NO: 13915 - DNA, 32 bp, Homo sapiens
ggccttccgagtagctgggattgcaggcgtgt

SEQ ID NO: 13916 - DNA, 32 bp, Homo sapiens
tcgatggcctgagacacaccccttgagaagaa

SEQ ID NO: 13917 - DNA, 32 bp, Homo sapiens
gcttctcccgcaggagcttcgggcttctcctg

SEQ ID NO: 13918 - DNA, 32 bp, Homo sapiens
aaaagactcagaggagagagataaggaaggaa

SEQ ID NO: 13919 - DNA, 32 bp, Homo sapiens
gcaaaccagccttttctaataggctaatattg

SEQ ID NO: 13920 - DNA, 22 bp, Homo sapiens
cagtgggagttccttccagccc

SEQ ID NO: 13921 - DNA, 32 bp, Homo sapiens
tttgagatgagtttcactcttgttgcccaggc

SEQ ID NO: 13922 - DNA, 32 bp, Homo sapiens
taatggtgtcactgctggcaatggtgataatg

SEQ ID NO: 13923 - DNA, 32 bp, Homo sapiens
caaggacggacgggagctccactgtgaatcgg

SEQ ID NO: 13924 - DNA, 32 bp, Homo sapiens
acagttgcctacagtattcagtgcagtaacat

SEQ ID NO: 13925 - DNA, 32 bp, Homo sapiens
aagattttcttgggcatctcccggaaagtgcg

SEQ ID NO: 13926 - DNA, 32 bp, Homo sapiens
cgagaacagattctcccctccagtatgggccc

SEQ ID NO: 13927 - DNA, 32 bp, Homo sapiens
agacagcctcttctcctctggggcctcaagaa

SEQ ID NO: 13928 - DNA, 28 bp, Homo sapiens
tcggagaaggctctacagggaaggggtc

SEQ ID NO: 13929 - DNA, 23 bp, Homo sapiens
gtcacccaggctggagcgcagtg

SEQ ID NO: 13930 - DNA, 32 bp, Homo sapiens
agcagaagagcctccttcagcagctactgact

SEQ ID NO: 13931 - DNA, 32 bp, Homo sapiens
ttcttgttgcctaggctggagtgcaatggcga

SEQ ID NO: 13932 - DNA, 32 bp, Homo sapiens
tggctggttcccaggctgcgctggtgttcagc

SEQ ID NO: 13933 - DNA, 32 bp, Homo sapiens
gttcccacagaactttggcacattctgaagaa

SEQ ID NO: 13934 - DNA, 32 bp, Homo sapiens
tgctgcaccattttgtattcccatgagcaggt

SEQ ID NO: 13935 - DNA, 28 bp, Homo sapiens
ggaccccctggccctgcctcatccacca

SEQ ID NO: 13936 - DNA, 32 bp, Homo sapiens
tgtcctcatcacctgtgtctttgctgcttttg

SEQ ID NO: 13937 - DNA, 20 bp, Homo sapiens
gccatcactgctggacagga

SEQ ID NO: 13938 - DNA, 32 bp, Homo sapiens
ctgaacaacctgtttcaaattggttttaaggc

SEQ ID NO: 13939 - DNA, 32 bp, Homo sapiens
tatcaaagcccaagaaatggaactttgggcag

SEQ ID NO: 13940 - DNA, 32 bp, Homo sapiens
gtccgtcggcccagactgaagtgcagtggcac

SEQ ID NO: 13941 - DNA, 32 bp, Homo sapiens
tggggtggcagcagggacagaaaacaacagag

SEQ ID NO: 13942 - DNA, 32 bp, Homo sapiens
tcgtcctcagttctgcggagacagagtcccca

SEQ ID NO: 13943 - DNA, 32 bp, Homo sapiens
gcttgtggacaacaggtcaatcattttcaaaa

SEQ ID NO: 13944 - DNA, 32 bp, Homo sapiens
caccaacatacaagtcttgacaacagcatctg

SEQ ID NO: 13945 - DNA, 32 bp, Homo sapiens
atgctggggacgcagaggtgacccagagacat

SEQ ID NO: 13946 - DNA, 32 bp, Homo sapiens
cctatgtgccagaggtactgtgcagtgctgga

SEQ ID NO: 13947 - DNA, 32 bp, Homo sapiens
agcctcctgagtagctgggactacaggcacgt

SEQ ID NO: 13948 - DNA, 32 bp, Homo sapiens
acggcccctacaggctggccctgcaatggggc

SEQ ID NO: 13949 - DNA, 32 bp, Homo sapiens
acctcagcctcctgggctcaagcaattctcat

SEQ ID NO: 13950 - DNA, 24 bp, Homo sapiens
tcacgcctgtaatcccagcacttt

SEQ ID NO: 13951 - DNA, 32 bp, Homo sapiens
ttagtttggcctgggcttctcagcttgtccag

SEQ ID NO: 13952 - DNA, 32 bp, Homo sapiens
ggcctcccaaagtgctgggattccaggcgtga

SEQ ID NO: 13953 - DNA, 32 bp, Homo sapiens
atcggacttgcagcttcattttgggctgcctt

SEQ ID NO: 13954 - DNA, 22 bp, Homo sapiens
tgtggacctaaagaggtgggga

SEQ ID NO: 13955 - DNA, 18 bp, Homo sapiens
gcccctcctgcccaagtg

SEQ ID NO: 13956 - DNA, 32 bp, Homo sapiens
gttggggtgctgcttgttcaggctcccctgac

SEQ ID NO: 13957 - DNA, 32 bp, Homo sapiens
agtaggtcttgtgggcattcagtctagcccag

SEQ ID NO: 13958 - DNA, 20 bp, Homo sapiens
ggtggctgggcgtggtggct

SEQ ID NO: 13959 - DNA, 32 bp, Homo sapiens
actctgttgcccaggctggagtaaagggcagt

SEQ ID NO: 13960 - DNA, 32 bp, Homo sapiens
tgctctgccccttctgctcactgtgaaggccg

SEQ ID NO: 13961 - DNA, 32 bp, Homo sapiens
acagtgatgctgctgctaagggcttccaaaca

SEQ ID NO: 13962 - DNA, 32 bp, Homo sapiens
caggcacaacctaggatcctttgctaccagtt

SEQ ID NO: 13963 - DNA, 28 bp, Homo sapiens
tggatgctgggtggcgcctcatctgcat

SEQ ID NO: 13964 - DNA, 32 bp, Homo sapiens
taaatcccaagtgtctcttgactggctcaaga

SEQ ID NO: 13965 - DNA, 32 bp, Homo sapiens
gatcccaggaggcggaggttgcagtgagttgc

SEQ ID NO: 13966 - DNA, 32 bp, Homo sapiens
agcctccctagtggctgggattacaggcgcct

SEQ ID NO: 13967 - DNA, 32 bp, Homo sapiens
aaacctttgtcaggctgggcgcggtggctcac

SEQ ID NO: 13968 - DNA, 32 bp, Homo sapiens
ttacagaatagcacttctgataagctgtatta

SEQ ID NO: 13969 - DNA, 32 bp, Homo sapiens
gtggcgcagctttctgtgtgatgcagatgtgt

SEQ ID NO: 13970 - DNA, 32 bp, Homo sapiens
gagcgcttggaagtttctcttctacctgggca

SEQ ID NO: 13971 - DNA, 32 bp, Homo sapiens
ctggactctagtgatctgcccacctcaacctc

SEQ ID NO: 13972 - DNA, 32 bp, Homo sapiens
actctcacacccaggctggagtgcagtctcaa

SEQ ID NO: 13973 - DNA, 32 bp, Homo sapiens
agtctgtcacccaggttggagtgcagtggcgt

SEQ ID NO: 13974 - DNA, 32 bp, Homo sapiens
gctctgtcgcccaggctggagtgcactggcgc

SEQ ID NO: 13975 - DNA, 32 bp, Homo sapiens
aggtcacctggactctgctcccaggaagctgt

SEQ ID NO: 13976 - DNA, 32 bp, Homo sapiens
gcctcaacctcctgggttcaagtgattctccc

SEQ ID NO: 13977 - DNA, 32 bp, Homo sapiens
ccatgttgcccaggctggtctgaagctgctgg

SEQ ID NO: 13978 - DNA, 32 bp, Homo sapiens
agcctcctgagtaactgggattacagagccca

SEQ ID NO: 13979 - DNA, 32 bp, Homo sapiens
tggctggctaacttcatggataagctacaaat

SEQ ID NO: 13980 - DNA, 32 bp, Homo sapiens
gtgctctgcaccccctgctcccttgggctggc

SEQ ID NO: 13981 - DNA, 24 bp, Homo sapiens
tcatgcctataatctcagcacttt

SEQ ID NO: 13982 - DNA, 32 bp, Homo sapiens
tatgcatattttatgggggcagtattattaca

SEQ ID NO: 13983 - DNA, 32 bp, Homo sapiens
ggcctcctgattagctgggattacaggcatgt

SEQ ID NO: 13984 - DNA, 32 bp, Homo sapiens
agatggccagttctttctacctcagagtgagt

SEQ ID NO: 13985 - DNA, 32 bp, Homo sapiens
agggtgccgtttcctgctccagctccagacct

SEQ ID NO: 13986 - DNA, 24 bp, Homo sapiens
tcatgcttgtaatcccggcacttt

SEQ ID NO: 13987 - DNA, 32 bp, Homo sapiens
gaagacccaagtgagtttgaaacacctgctct

SEQ ID NO: 13988 - DNA, 32 bp, Homo sapiens
gagcccgggaagtggaggttgcactgagctga

SEQ ID NO: 13989 - DNA, 32 bp, Homo sapiens
tgtcatcattgtgacttcctggtagcccaaga

SEQ ID NO: 13990 - DNA, 28 bp, Homo sapiens
cccccgggaggtgctgcctcgtctaccc

SEQ ID NO: 13991 - DNA, 32 bp, Homo sapiens
tgctccttcaaggcccttaaaactgtgggctc

SEQ ID NO: 13992 - DNA, 32 bp, Homo sapiens
tcttgtcaaccgggctggagtgcagtggtgca

SEQ ID NO: 13993 - DNA, 19 bp, Homo sapiens
cccctgtctggtcccagta

SEQ ID NO: 13994 - DNA, 32 bp, Homo sapiens
agtcacatcccaggctggggatggatgctctg

SEQ ID NO: 13995 - DNA, 21 bp, Homo sapiens
ctgaccaacatggtagaaccc

SEQ ID NO: 13996 - DNA, 32 bp, Homo sapiens
taaatcttgctgctgctcactctttgggtcca

SEQ ID NO: 13997 - DNA, 19 bp, Homo sapiens
ggtctccagagcgcttgca

SEQ ID NO: 13998 - DNA, 32 bp, Homo sapiens
cctcaacaggggtccagggtgcagtgaactca

SEQ ID NO: 13999 - DNA, 32 bp, Homo sapiens
ctttgtcagccaggctggagtgcagtgacacg

SEQ ID NO: 14000 - DNA, 32 bp, Homo sapiens
ggacctgtagccacctgcaccaggagctggac

SEQ ID NO: 14001 - DNA, 28 bp, Homo sapiens
ggaagcccaagtgttggccatcctcaac

SEQ ID NO: 14002 - DNA, 31 bp, Homo sapiens
cgtggacagcaagccgtgaggagggagcccg

SEQ ID NO: 14003 - DNA, 32 bp, Homo sapiens
cctctgtcgcccaggctggagtgcaatggcgc

SEQ ID NO: 14004 - DNA, 32 bp, Homo sapiens
gggcctacactgcctcctcccacgccgtgctt

SEQ ID NO: 14005 - DNA, 32 bp, Homo sapiens
tcatgattacagtctagagttacttgaaatgg

SEQ ID NO: 14006 - DNA, 32 bp, Homo sapiens
gcaaactctgcaggtgtctttcttatcctagt

SEQ ID NO: 14007 - DNA, 32 bp, Homo sapiens
cccgtctctcctctccccattctgtgccctac

SEQ ID NO: 14008 - DNA, 32 bp, Homo sapiens
cgctgagcagaacttgccgccagaatgctcct

SEQ ID NO: 14009 - DNA, 32 bp, Homo sapiens
taggtggtgctgctgctccattcccaagtaac

SEQ ID NO: 14010 - DNA, 32 bp, Homo sapiens
gcgtcacataagccagcccacagggtcctgca

SEQ ID NO: 14011 - DNA, 32 bp, Homo sapiens
gaactttaacatcagtcattgcacaggagcta

SEQ ID NO: 14012 - DNA, 32 bp, Homo sapiens
ccgggttcaagcaattctcccgcctcagcccc

SEQ ID NO: 14013 - DNA, 32 bp, Homo sapiens
agcctccctagtagctgggattacaggcatgc

SEQ ID NO: 14014 - DNA, 32 bp, Homo sapiens
agcctcctgagtagctgagattacaggtgtgt

SEQ ID NO: 14015 - DNA, 32 bp, Homo sapiens
cgctctgtcgccaggctggagtacagtggtgt

SEQ ID NO: 14016 - DNA, 32 bp, Homo sapiens
caacatcatcttgggagagaggcacagacctg

SEQ ID NO: 14017 - DNA, 32 bp, Homo sapiens
actccgaaagtctgaatctcccaaggagggca

SEQ ID NO: 14018 - DNA, 32 bp, Homo sapiens
ctgggctcaagcaattcttccacctcagcctc

SEQ ID NO: 14019 - DNA, 32 bp, Homo sapiens
catcaaaggagggattatgtggctgctaaagc

SEQ ID NO: 14020 - DNA, 32 bp, Homo sapiens
gtggcaggtgctccaggctgtgatctgcaccc

SEQ ID NO: 14021 - DNA, 32 bp, Homo sapiens
aactaacaactccagacgcaccacctttatga

SEQ ID NO: 14022 - DNA, 32 bp, Homo sapiens
tcctgggctcaagcaattcttctgcctcagcc

SEQ ID NO: 14023 - DNA, 32 bp, Homo sapiens
accagatcaagcaattctatctatttacacta

SEQ ID NO: 14024 - DNA, 32 bp, Homo sapiens
cgctttgccatgtaaatttcccagaagttgtt

SEQ ID NO: 14025 - DNA, 32 bp, Homo sapiens
acatgtccctctggagcttccacctggccagg

SEQ ID NO: 14026 - DNA, 32 bp, Homo sapiens
gtcttgcagcttttattccctgtgcaacaaaa

SEQ ID NO: 14027 - DNA, 32 bp, Homo sapiens
ctcttgttgcccaggctggagtgcaatagcgc

SEQ ID NO: 14028 - DNA, 32 bp, Homo sapiens
ttttgagacagtttcgctctgttgcccaggct

SEQ ID NO: 14029 - DNA, 32 bp, Homo sapiens
gaggggcatccctccctgccggcctcagggag

SEQ ID NO: 14030 - DNA, 32 bp, Homo sapiens
aagaattgtataatatacccccatgaacttgt

SEQ ID NO: 14031 - DNA, 32 bp, Homo sapiens
agagggggtaagaccttcctgggaccgcaaaa

SEQ ID NO: 14032 - DNA, 32 bp, Homo sapiens
aaatgttcctgattgctggaagctgcggctca

SEQ ID NO: 14033 - DNA, 24 bp, Homo sapiens
tcactcctgtaatcccggcacttt

SEQ ID NO: 14034 - DNA, 32 bp, Homo sapiens
agcctcctgagtagctagggttacctgccacc

SEQ ID NO: 14035 - DNA, 32 bp, Homo sapiens
agggcacagccaggctggagtcagtgtctgcc

SEQ ID NO: 14036 - DNA, 18 bp, Homo sapiens
ctgacctgcaacttgact

SEQ ID NO: 14037 - DNA, 24 bp, Homo sapiens
tcatgcctttaatcccagcatttt

SEQ ID NO: 14038 - DNA, 20 bp, Homo sapiens
gcctgcaatcccagcacttt

SEQ ID NO: 14039 - DNA, 32 bp, Homo sapiens
ctgttctcagctctgtcatctgcagggcttct

SEQ ID NO: 14040 - DNA, 32 bp, Homo sapiens
ttttctccaatttgcctgaatatttcaggagg

SEQ ID NO: 14041 - DNA, 32 bp, Homo sapiens
ccaccctcacaaggagctgccatcctgtttgg

SEQ ID NO: 14042 - DNA, 32 bp, Homo sapiens
tggccttcaccccgggcctcttaacttcaggt

SEQ ID NO: 14043 - DNA, 32 bp, Homo sapiens
agcctcccaagtagctgggattacagactcat

SEQ ID NO: 14044 - DNA, 32 bp, Homo sapiens
agcctcctgagtagctgggactacaggcgctc

SEQ ID NO: 14045 - DNA, 32 bp, Homo sapiens
cagtaagtatctggaggaagaaaacaggtgaa

SEQ ID NO: 14046 - DNA, 32 bp, Homo sapiens
tacttttcaagcaaattcaacaaatcagtgta

SEQ ID NO: 14047 - DNA, 32 bp, Homo sapiens
cgtcgtggctcaagcccggccacgccgcccca

SEQ ID NO: 14048 - DNA, 32 bp, Homo sapiens
agacgtcatcttcttctaaagggccgtgactc

SEQ ID NO: 14049 - DNA, 32 bp, Homo sapiens
caatgggctctgtggggcaggtgcagaggccc

SEQ ID NO: 14050 - DNA, 24 bp, Homo sapiens
tcatgcctataatcccaacacttt

SEQ ID NO: 14051 - DNA, 32 bp, Homo sapiens
ggcaggccagttctaatttccaatagataagt

SEQ ID NO: 14052 - DNA, 32 bp, Homo sapiens
taagaatagcactgatctcacagggttgtgat

SEQ ID NO: 14053 - DNA, 32 bp, Homo sapiens
cacctgcagctttgccttttgctgacacagct

SEQ ID NO: 14054 - DNA, 32 bp, Homo sapiens
acctccacttcccaggttcaagcgatcctcct

SEQ ID NO: 14055 - DNA, 32 bp, Homo sapiens
gaatataggaggcagaggttgcagtgagccga

SEQ ID NO: 14056 - DNA, 32 bp, Homo sapiens
tcagtctctgcagtttctctacctgcccccag

SEQ ID NO: 14057 - DNA, 32 bp, Homo sapiens
cctctccctgcagctttcactgctcttgccta

SEQ ID NO: 14058 - DNA, 32 bp, Homo sapiens
catatactatttagtctcaggttcaaggctac

SEQ ID NO: 14059 - DNA, 32 bp, Homo sapiens
agaaccaggatcctgagatgagcttgagcttt

SEQ ID NO: 14060 - DNA, 32 bp, Homo sapiens
attcttcccaaggcagcttcagctaggagttt

SEQ ID NO: 14061 - DNA, 32 bp, Homo sapiens
tcagcctgggcagcttccccctgccttttgca

SEQ ID NO: 14062 - DNA, 32 bp, Homo sapiens
caaatactacaggcccttaaagcacagtctga

SEQ ID NO: 14063 - DNA, 32 bp, Homo sapiens
ctggagaaatggcatcattataagctatgagt

SEQ ID NO: 14064 - DNA, 32 bp, Homo sapiens
acctctgtctcctgggctcaagcaattcttct

SEQ ID NO: 14065 - DNA, 32 bp, Homo sapiens
cggtctccaagtgcccctggttacagctcctg

SEQ ID NO: 14066 - DNA, 21 bp, Homo sapiens
tgcctgtaatcccaacacttt

SEQ ID NO: 14067 - DNA, 32 bp, Homo sapiens
tgaggaagaagaggaggaggaggaagaggagg

SEQ ID NO: 14068 - DNA, 32 bp, Homo sapiens
agcctcttgagtggctgggattgcaggcgccc

SEQ ID NO: 14069 - DNA, 32 bp, Homo sapiens
gctctgtcgccaggactggagtgcagtgacac

SEQ ID NO: 14070 - DNA, 32 bp, Homo sapiens
cccaccctgacagcccaacaccaccttcctcc

SEQ ID NO: 14071 - DNA, 24 bp, Homo sapiens
tcacacctgtaatcccaacagttt

SEQ ID NO: 14072 - DNA, 32 bp, Homo sapiens
atggaatgcctagtgctaagtgcagtgtcctt

SEQ ID NO: 14073 - DNA, 32 bp, Homo sapiens
ggcataaatgttcaatctaacggctttggttg

SEQ ID NO: 14074 - DNA, 32 bp, Homo sapiens
ctatattgcccaagctacagtgcaatgattaa

SEQ ID NO: 14075 - DNA, 32 bp, Homo sapiens
acctctgcctcccgggttcaagcaattccctg

SEQ ID NO: 14076 - DNA, 28 bp, Homo sapiens
tcataatcaagtgctggctaatgtcagc

SEQ ID NO: 14077 - DNA, 32 bp, Homo sapiens
ttccacgggagaggagaaacttaaagaggttt

SEQ ID NO: 14078 - DNA, 32 bp, Homo sapiens
ccaggttcaagcaattctcctgcctcagctcc

SEQ ID NO: 14079 - DNA, 32 bp, Homo sapiens
ctgggctcaagcaatcctcctgcctcggcttc

SEQ ID NO: 14080 - DNA, 23 bp, Homo sapiens
tcatgcctgacatctcagcactt

SEQ ID NO: 14081 - DNA, 20 bp, Homo sapiens
cagggggcccaaggagcagt

SEQ ID NO: 14082 - DNA, 24 bp, Homo sapiens
atcctcctccagggactgctgtga

SEQ ID NO: 14083 - DNA, 32 bp, Homo sapiens
gaagcgagcacaggctggggtggatgacttat

SEQ ID NO: 14084 - DNA, 32 bp, Homo sapiens
ggctcctctgcagcctgccctgccttcccccg

SEQ ID NO: 14085 - DNA, 32 bp, Homo sapiens
tcttatctaatttatctcttctggacccatgt

SEQ ID NO: 14086 - DNA, 32 bp, Homo sapiens
tctctgtcccccaggctgaagtgcagcggcat

SEQ ID NO: 14087 - DNA, 32 bp, Homo sapiens
tcactgtcacccaggctgaactgcagtggtgt

SEQ ID NO: 14088 - DNA, 32 bp, Homo sapiens
tggggagagggaggagaaagaggaggatctcg

SEQ ID NO: 14089 - DNA, 32 bp, Homo sapiens
ctatccacgcctatgaatctttggacggtgag

SEQ ID NO: 14090 - DNA, 28 bp, Homo sapiens
tgtggcctgcatgctgcctgatcttgcc

SEQ ID NO: 14091 - DNA, 32 bp, Homo sapiens
aacccgggaaggcggaagttgcagtgagccga

SEQ ID NO: 14092 - DNA, 32 bp, Homo sapiens
gagcccaggaggtcaagactgcagtgagctat

SEQ ID NO: 14093 - DNA, 32 bp, Homo sapiens
aaaaccaagatggggagaagaaaacagcacaa

SEQ ID NO: 14094 - DNA, 32 bp, Homo sapiens
tggcccaggcctggcgggcactgcttcccggc

SEQ ID NO: 14095 - DNA, 28 bp, Homo sapiens
cccgtctcaagtgctcctcttccttcca

SEQ ID NO: 14096 - DNA, 32 bp, Homo sapiens
aatttggaagcctctttctgaaatcattagct

SEQ ID NO: 14097 - DNA, 32 bp, Homo sapiens
ctcactcccccaaaatgacacccaccgtcgtc

SEQ ID NO: 14098 - DNA, 17 bp, Homo sapiens
gcccctctgtgtccagg

SEQ ID NO: 14099 - DNA, 23 bp, Homo sapiens
tgacacaatctcggctcactgca

SEQ ID NO: 14100 - DNA, 23 bp, Homo sapiens
tggcacgatctccacgcactaca

SEQ ID NO: 14101 - DNA, 24 bp, Homo sapiens
gtcacccaggctggagtgccatag

SEQ ID NO: 14102 - DNA, 32 bp, Homo sapiens
caccccaatgttctggaggctgcggttctgct

SEQ ID NO: 14103 - DNA, 32 bp, Homo sapiens
cccaccgcctcttctccatctgagaatcacgg

SEQ ID NO: 14104 - DNA, 32 bp, Homo sapiens
ctctgctgcccaggctggaatgcagtggtgcc

SEQ ID NO: 14105 - DNA, 28 bp, Homo sapiens
atccccaagaatgctgccttgtctgtgg

SEQ ID NO: 14106 - DNA, 32 bp, Homo sapiens
ggcagtgggaggcaagagtgaagcagaggaga

SEQ ID NO: 14107 - DNA, 32 bp, Homo sapiens
agatcgccagaacttaggacacatgggatgga

SEQ ID NO: 14108 - DNA, 22 bp, Homo sapiens
cagggagcctcttcctcaaccc

SEQ ID NO: 14109 - DNA, 32 bp, Homo sapiens
ttgagacggagttttgttcttgttgcccaggc

SEQ ID NO: 14110 - DNA, 32 bp, Homo sapiens
cggagggtgacgggggtgaacttggttcccat

SEQ ID NO: 14111 - DNA, 32 bp, Homo sapiens
gaacctgggaagtggaggctgcagtgagccca

SEQ ID NO: 14112 - DNA, 32 bp, Homo sapiens
gctgcacgggtactgaatcttctacgactgaa

SEQ ID NO: 14113 - DNA, 32 bp, Homo sapiens
ccaggttggccaggctggtcttgtgaactcct

SEQ ID NO: 14114 - DNA, 32 bp, Homo sapiens
gcctccatcctctgggttcaagcaattctcct

SEQ ID NO: 14115 - DNA, 28 bp, Homo sapiens
caccacccaagctgtgcctcatggagtc

SEQ ID NO: 14116 - DNA, 32 bp, Homo sapiens
gcctgttcaagtgcccttgctaccagttccga

SEQ ID NO: 14117 - DNA, 32 bp, Homo sapiens
ggacagagcccaaaacgggggtagactttgtg

SEQ ID NO: 14118 - DNA, 32 bp, Homo sapiens
atccacagtctacaaaaccccacagctcctga

SEQ ID NO: 14119 - DNA, 32 bp, Homo sapiens
ctctgtcgcccaggctggagcccagtggcgag

SEQ ID NO: 14120 - DNA, 19 bp, Homo sapiens
gaagcatcgtgcatagttc

SEQ ID NO: 14121 - DNA, 32 bp, Homo sapiens
agacgtggccttgaagcccacagggttgatgg

SEQ ID NO: 14122 - DNA, 32 bp, Homo sapiens
gtaccaaactgatttcaaaagtactacattga

SEQ ID NO: 14123 - DNA, 32 bp, Homo sapiens
caaaagaaagagacttcatttggcagttctga

SEQ ID NO: 14124 - DNA, 32 bp, Homo sapiens
gaacccaggagacggaggttgcagtgagccga

SEQ ID NO: 14125 - DNA, 32 bp, Homo sapiens
cctcatgttccatggggctgtgcagtgcaatg

SEQ ID NO: 14126 - DNA, 32 bp, Homo sapiens
taaaaagcctccatcactctatttggctcatt

SEQ ID NO: 14127 - DNA, 32 bp, Homo sapiens
atctgtcacccaggctggagtgcagtggcaca

SEQ ID NO: 14128 - DNA, 32 bp, Homo sapiens
acctccgcctcctgggttcaagcaattctgtg

SEQ ID NO: 14129 - DNA, 32 bp, Homo sapiens
gaacccaggaggcggaggttgcagtgaaccga

SEQ ID NO: 14130 - DNA, 32 bp, Homo sapiens
tccccaggacctggatgacacccgcctcactg

SEQ ID NO: 14131 - DNA, 21 bp, Homo sapiens
tgcagggggagggagagggga

SEQ ID NO: 14132 - DNA, 32 bp, Homo sapiens
aggaggtagagaggagaaagagagcagcccgg

SEQ ID NO: 14133 - DNA, 32 bp, Homo sapiens
ttaacatcacccagatttcttcagttataaat

SEQ ID NO: 14134 - DNA, 32 bp, Homo sapiens
ctaagaaatcatatgaccaatatttcacttat

SEQ ID NO: 14135 - DNA, 18 bp, Homo sapiens
gccacctggcacctagaa

SEQ ID NO: 14136 - DNA, 32 bp, Homo sapiens
caacattccgggacagggagatcatgtttcac

SEQ ID NO: 14137 - DNA, 32 bp, Homo sapiens
tgaaccaggagacggaggttgcagtgagctga

SEQ ID NO: 14138 - DNA, 32 bp, Homo sapiens
agcctcctaagtagctgggattacaagtgccc

SEQ ID NO: 14139 - DNA, 28 bp, Homo sapiens
ttgtctccagtacttgcctcattctcat

SEQ ID NO: 14140 - DNA, 32 bp, Homo sapiens
atttcaatgacttttaagaacaacagcccttc

SEQ ID NO: 14141 - DNA, 32 bp, Homo sapiens
ctgtgctcaagtgaccctcccacctcattctc

SEQ ID NO: 14142 - DNA, 32 bp, Homo sapiens
ctgggttcaagtaaccctcccacctcagcttt

SEQ ID NO: 14143 - DNA, 32 bp, Homo sapiens
tataaatacctgcactgtctctgaggacttac

SEQ ID NO: 14144 - DNA, 32 bp, Homo sapiens
ggtttcaagccaaatgtgaatttatttgggtt

SEQ ID NO: 14145 - DNA, 32 bp, Homo sapiens
aactgcattaaccagtcacaggctcagactgt

SEQ ID NO: 14146 - DNA, 27 bp, Homo sapiens
aagatgcaggagagaggaagccttgca

SEQ ID NO: 14147 - DNA, 32 bp, Homo sapiens
agctaggtacagaggaatgtttgctaccttta

SEQ ID NO: 14148 - DNA, 32 bp, Homo sapiens
caggtctgtcccggctggagaacagcgtccac

SEQ ID NO: 14149 - DNA, 32 bp, Homo sapiens
tcagtctatgttctttaggtagctagacacaa

SEQ ID NO: 14150 - DNA, 32 bp, Homo sapiens
agagactggcagcacctcctggaacacaagcc

SEQ ID NO: 14151 - DNA, 32 bp, Homo sapiens
acctctgcctcctgggctcaagcaattctccc

SEQ ID NO: 14152 - DNA, 32 bp, Homo sapiens
acagctccagacatgtccaacaacagccccga

SEQ ID NO: 14153 - DNA, 32 bp, Homo sapiens
gtttacagaagctggtggctgtggagacaaat

SEQ ID NO: 14154 - DNA, 32 bp, Homo sapiens
ctgtcttgcccaggctggagtgcagtggcctg

SEQ ID NO: 14155 - DNA, 32 bp, Homo sapiens
caggagattgagaccttcctggctaacatggt

SEQ ID NO: 14156 - DNA, 32 bp, Homo sapiens
agtcaacatcttcatcattgggctttctttaa

SEQ ID NO: 14157 - DNA, 32 bp, Homo sapiens
atagactgaagaggagcaagaacagaaacagg

SEQ ID NO: 14158 - DNA, 32 bp, Homo sapiens
cagcctccgagtagctgggactacaggtgcac

SEQ ID NO: 14159 - DNA, 32 bp, Homo sapiens
gttttgagcaaaattttggactgtgaagcaag

SEQ ID NO: 14160 - DNA, 32 bp, Homo sapiens
gcccccagcccctcgtcgcgggttcaggtccg

SEQ ID NO: 14161 - DNA, 18 bp, Homo sapiens
tgtggggatgaaatgggg

SEQ ID NO: 14162 - DNA, 32 bp, Homo sapiens
gagcccgggaggcggagattgcggtgagccaa

SEQ ID NO: 14163 - DNA, 32 bp, Homo sapiens
ctattctttatttcagtgtagcacttttagag

SEQ ID NO: 14164 - DNA, 32 bp, Homo sapiens
tcctttgggcctggggctgtgcttggcttgaa

SEQ ID NO: 14165 - DNA, 32 bp, Homo sapiens
tgttgttgcccaggctggagtgcaatagcacg

SEQ ID NO: 14166 - DNA, 32 bp, Homo sapiens
atcattcccagaaacatttcccagaaaatgtt

SEQ ID NO: 14167 - DNA, 32 bp, Homo sapiens
tgaaactctgcaggccttccgcctgattatta

SEQ ID NO: 14168 - DNA, 27 bp, Homo sapiens
ccaacatagtttcaccccatctctact

SEQ ID NO: 14169 - DNA, 32 bp, Homo sapiens
gacgcggaaggccctgggggtgcagtggagcg

SEQ ID NO: 14170 - DNA, 32 bp, Homo sapiens
acagttctgtctctactacctgatctcctcct

SEQ ID NO: 14171 - DNA, 32 bp, Homo sapiens
gaaggctgaacacaggcttgttaatgtcagtc

SEQ ID NO: 14172 - DNA, 32 bp, Homo sapiens
atagttttaacaacaggaaacacttgtaggac

SEQ ID NO: 14173 - DNA, 32 bp, Homo sapiens
atgacaataccagccctggactacctacctgt

SEQ ID NO: 14174 - DNA, 32 bp, Homo sapiens
agaatggggaggcaagatctcagggacaccaa

SEQ ID NO: 14175 - DNA, 32 bp, Homo sapiens
aactgcaaattggtaagcagcaccttaatacc

SEQ ID NO: 14176 - DNA, 32 bp, Homo sapiens
cacaatttgagcaattcatttcactttaaagt

SEQ ID NO: 14177 - DNA, 32 bp, Homo sapiens
ctgggctcaagcaaccctcccaccttagcctc

SEQ ID NO: 14178 - DNA, 21 bp, Homo sapiens
ggtctagaggggtctggggca

SEQ ID NO: 14179 - DNA, 32 bp, Homo sapiens
acctgtccaagggtaggcaaccaccttcacct

SEQ ID NO: 14180 - DNA, 32 bp, Homo sapiens
tgtgagtcttccagctttcttctgctttttca

SEQ ID NO: 14181 - DNA, 32 bp, Homo sapiens
gaacccaggaggcagaagttgcagtgagcaga

SEQ ID NO: 14182 - DNA, 32 bp, Homo sapiens
caggtgcgggggcagagggtgacttaccaaga

SEQ ID NO: 14183 - DNA, 32 bp, Homo sapiens
ggcttcagagagggagaagcactgtgaggcct

SEQ ID NO: 14184 - DNA, 32 bp, Homo sapiens
ccatgtttgccaggctggtcctgaatgcctga

SEQ ID NO: 14185 - DNA, 32 bp, Homo sapiens
cccaaaccaagtgccttgagctgcctgctctg

SEQ ID NO: 14186 - DNA, 32 bp, Homo sapiens
tgtgtttctagagtgagatttgtgttttctgc

SEQ ID NO: 14187 - DNA, 32 bp, Homo sapiens
aggggctaaagaggaggacgaagaaaagcaga

SEQ ID NO: 14188 - DNA, 32 bp, Homo sapiens
ggagtgcagagaggagaactgaaaataaaact

SEQ ID NO: 14189 - DNA, 32 bp, Homo sapiens
actgttcagggccacggagaattctcgaagtc

SEQ ID NO: 14190 - DNA, 32 bp, Homo sapiens
tgcagcccatggagagcaactacacggtgctg

SEQ ID NO: 14191 - DNA, 24 bp, Homo sapiens
tcacgcctgtaatcccagtagttt

SEQ ID NO: 14192 - DNA, 24 bp, Homo sapiens
tcacccctgtaatcccagtacttt

SEQ ID NO: 14193 - DNA, 32 bp, Homo sapiens
cagaagtcagccgcaatccaggcacaggacga

SEQ ID NO: 14194 - DNA, 21 bp, Homo sapiens
tccatgcattgcacgctgcca

SEQ ID NO: 14195 - DNA, 32 bp, Homo sapiens
ccatggtcccccagcgtgcaccacctggcccg

SEQ ID NO: 14196 - DNA, 32 bp, Homo sapiens
tgctgtgtcaccaggctggagcagtggcacga

SEQ ID NO: 14197 - DNA, 23 bp, Homo sapiens
tggcacgatctcgactcactgca

SEQ ID NO: 14198 - DNA, 23 bp, Homo sapiens
tggcgcgatctcaactcactgca

SEQ ID NO: 14199 - DNA, 32 bp, Homo sapiens
gaacccaggaggcagagcttgcagtgagccta

SEQ ID NO: 14200 - DNA, 32 bp, Homo sapiens
gaatctgggaagcggaggttgcagtgagctga

SEQ ID NO: 14201 - DNA, 32 bp, Homo sapiens
gagtctgggaggcggaggttgcagtgagctga

SEQ ID NO: 14202 - DNA, 32 bp, Homo sapiens
cttcagaagaattgaggatctgatggaggttt

SEQ ID NO: 14203 - DNA, 32 bp, Homo sapiens
tgctcttgcccaggcaggagtacagtagtgca

SEQ ID NO: 14204 - DNA, 32 bp, Homo sapiens
gagccggggaggagggggttgcagtgagccga

SEQ ID NO: 14205 - DNA, 32 bp, Homo sapiens
tgcttgataatcactctcaggtgtaaagctcc

SEQ ID NO: 14206 - DNA, 32 bp, Homo sapiens
ctggactcaagcaaccctccctctttggcctc

SEQ ID NO: 14207 - DNA, 32 bp, Homo sapiens
agcctcctgagtagctgggataacagacatgc

SEQ ID NO: 14208 - DNA, 24 bp, Homo sapiens
ctgccgcccaggctagagtgcagt

SEQ ID NO: 14209 - DNA, 32 bp, Homo sapiens
aacctgcagctttatcggagtgatggcaatgc

SEQ ID NO: 14210 - DNA, 32 bp, Homo sapiens
gcacagcctctttcactcagaagctcaggtcg

SEQ ID NO: 14211 - DNA, 32 bp, Homo sapiens
agacctgcagaaccagcgtgtgtggggtgcag

SEQ ID NO: 14212 - DNA, 32 bp, Homo sapiens
ctgctgcggcccaagagtcactgtgaaggacc

SEQ ID NO: 14213 - DNA, 32 bp, Homo sapiens
gttgcacagctgctgctgacaggtctacctga

SEQ ID NO: 14214 - DNA, 32 bp, Homo sapiens
actttgacccccaggctggagtgcagtggcac

SEQ ID NO: 14215 - DNA, 32 bp, Homo sapiens
actctgtcgcgccagctggagtgcagtgccat

SEQ ID NO: 14216 - DNA, 32 bp, Homo sapiens
tgcacttcccacagactggagtttttggtgct

SEQ ID NO: 14217 - DNA, 32 bp, Homo sapiens
gaactggggaggcagaggttgcagtgagacaa

SEQ ID NO: 14218 - DNA, 32 bp, Homo sapiens
ggtggcggcgggcagaggtgatgtctgggagc

SEQ ID NO: 14219 - DNA, 32 bp, Homo sapiens
cctacactactgatacaaatggtgttaactgg

SEQ ID NO: 14220 - DNA, 32 bp, Homo sapiens
gggacagggaattggccctgggagaaaacgcg

SEQ ID NO: 14221 - DNA, 32 bp, Homo sapiens
ctccgtcatccaagctggagtgcagtggtgca

SEQ ID NO: 14222 - DNA, 31 bp, Homo sapiens
caaaccaacaacacagctggggcgggccctg

SEQ ID NO: 14223 - DNA, 32 bp, Homo sapiens
tgaaatttccatattgagagaagccaaacatt

SEQ ID NO: 14224 - DNA, 32 bp, Homo sapiens
caatcgtcacccacattggagtgcagtggtac

SEQ ID NO: 14225 - DNA, 25 bp, Homo sapiens
gggtatttttcttgggggtggagta

SEQ ID NO: 14226 - DNA, 21 bp, Homo sapiens
aagttgtccaaaagccttcag

SEQ ID NO: 14227 - DNA, 31 bp, Homo sapiens
aataacaacaacaacaaaacagcagaggaat

SEQ ID NO: 14228 - DNA, 32 bp, Homo sapiens
gctgtgttgcccaggctggagtgcagtggcct

SEQ ID NO: 14229 - DNA, 32 bp, Homo sapiens
agcggggaggaggagaaggatgcagccgccga

SEQ ID NO: 14230 - DNA, 32 bp, Homo sapiens
gagcccccagttctctgtcccctagcactaga

SEQ ID NO: 14231 - DNA, 32 bp, Homo sapiens
aactccgcctcctgggttcaagtgattcttct

SEQ ID NO: 14232 - DNA, 32 bp, Homo sapiens
acctctgcctcctgggttcaagcgattatcct

SEQ ID NO: 14233 - DNA, 32 bp, Homo sapiens
gaacccgggaggtggagcttgcagtgagcgga

SEQ ID NO: 14234 - DNA, 32 bp, Homo sapiens
gactcatgcctgtaatcctagcactttgggag

SEQ ID NO: 14235 - DNA, 32 bp, Homo sapiens
tggcaggctgggggctgggatgtgatgggtgt

SEQ ID NO: 14236 - DNA, 32 bp, Homo sapiens
ctgtgtcacccaggctggagtgcagtggcgca

SEQ ID NO: 14237 - DNA, 25 bp, Homo sapiens
cgtcacccgggctggagtgcagtgg

SEQ ID NO: 14238 - DNA, 32 bp, Homo sapiens
ttctgtcacccagactggagtgcagtgccaca

SEQ ID NO: 14239 - DNA, 32 bp, Homo sapiens
ttggcaggctcacttctgaggtgcaaaacata

SEQ ID NO: 14240 - DNA, 19 bp, Homo sapiens
ctgctgttaacccgtgagg

SEQ ID NO: 14241 - DNA, 32 bp, Homo sapiens
aaggtgccgccctcatcacaggctgggcatgg

SEQ ID NO: 14242 - DNA, 23 bp, Homo sapiens
gccaccactgatgccacccagga

SEQ ID NO: 14243 - DNA, 28 bp, Homo sapiens
gggcagggcaggactgcctcatcctctg

SEQ ID NO: 14244 - DNA, 24 bp, Homo sapiens
ctgtcacccaggctggactgcaat

SEQ ID NO: 14245 - DNA, 32 bp, Homo sapiens
agcctcctgagtagctgggactacaggtgtac

SEQ ID NO: 14246 - DNA, 32 bp, Homo sapiens
ctccattgcccaggctggactgcagcagcgtg

SEQ ID NO: 14247 - DNA, 22 bp, Homo sapiens
gggccctcctcccctccttgca

SEQ ID NO: 14248 - DNA, 32 bp, Homo sapiens
tttgcgtgcatcagaatcacccagaaagatgt

SEQ ID NO: 14249 - DNA, 24 bp, Homo sapiens
tcacacctataatcccaatacttt

SEQ ID NO: 14250 - DNA, 32 bp, Homo sapiens
actctgttgcccagcctggagtgcagtgtgtc

SEQ ID NO: 14251 - DNA, 19 bp, Homo sapiens
cagtggcctctttcagccc

SEQ ID NO: 14252 - DNA, 23 bp, Homo sapiens
tggcacaatctcagttcactgca

SEQ ID NO: 14253 - DNA, 32 bp, Homo sapiens
ccgcctccgagcgacttccgggagccgggcgg

SEQ ID NO: 14254 - DNA, 32 bp, Homo sapiens
gaacctgggaggtggagcttgcagtgagcgga

SEQ ID NO: 14255 - DNA, 32 bp, Homo sapiens
cagctgcgcctaggctggagctggaagggtgg

SEQ ID NO: 14256 - DNA, 23 bp, Homo sapiens
catgcctgtaatcccagaacttt

SEQ ID NO: 14257 - DNA, 32 bp, Homo sapiens
tgcataacaataacaggaatgactttgcctgc

SEQ ID NO: 14258 - DNA, 32 bp, Homo sapiens
ggttcttggccaggctgtaggtggtggctcac

SEQ ID NO: 14259 - DNA, 32 bp, Homo sapiens
cctttcttctttgtcttatttctgccttcatc

SEQ ID NO: 14260 - DNA, 32 bp, Homo sapiens
aacgcctctgcagctgcagccctcgttctctt

SEQ ID NO: 14261 - DNA, 24 bp, Homo sapiens
tcacatctgtaaccccagcacttt

SEQ ID NO: 14262 - DNA, 32 bp, Homo sapiens
attctgtcacccgggctggagtgcagtggcgt

SEQ ID NO: 14263 - DNA, 32 bp, Homo sapiens
agtggcccagttctggttttctagattgtact

SEQ ID NO: 14264 - DNA, 32 bp, Homo sapiens
gctcaggagccagcagggcagagttctgcctg

SEQ ID NO: 14265 - DNA, 32 bp, Homo sapiens
tcttgttgcccaggctggagtgcaatggtatg

SEQ ID NO: 14266 - DNA, 32 bp, Homo sapiens
tttggctgcccaggctcgccttgactccaaat

SEQ ID NO: 14267 - DNA, 32 bp, Homo sapiens
gataggagaagaggaggaggaggagcggggtc

SEQ ID NO: 14268 - DNA, 32 bp, Homo sapiens
tatgcagggacaaggaggttgctgactgtact

SEQ ID NO: 14269 - DNA, 30 bp, Homo sapiens
taaaatggaaaggtcctgctgtggaaactt

SEQ ID NO: 14270 - DNA, 32 bp, Homo sapiens
gctctcttgtccaggctggagtgcaatagcgc

SEQ ID NO: 14271 - DNA, 32 bp, Homo sapiens
gagtccaggagttcaaggctgcagtgagttgt

SEQ ID NO: 14272 - DNA, 32 bp, Homo sapiens
ctcagtcgctcaggctggagtgcaatggtggg

SEQ ID NO: 14273 - DNA, 19 bp, Homo sapiens
caggaaggagctgcctgga

SEQ ID NO: 14274 - DNA, 32 bp, Homo sapiens
gaagaatgggaaagagaaagagacagagactg

SEQ ID NO: 14275 - DNA, 32 bp, Homo sapiens
agccctgtcaccacctggtccttcatgaagag

SEQ ID NO: 14276 - DNA, 32 bp, Homo sapiens
gctctgtcacccagactggagtgcagtggtgc

SEQ ID NO: 14277 - DNA, 32 bp, Homo sapiens
ggagcagaggtgagctgagtgcagtgagccaa

SEQ ID NO: 14278 - DNA, 32 bp, Homo sapiens
aacccaggaggcagagggttgcagtgagccga

SEQ ID NO: 14279 - DNA, 32 bp, Homo sapiens
actctgttgcccatgctggagggcagtggtat

SEQ ID NO: 14280 - DNA, 32 bp, Homo sapiens
actctgtcgcccaggctggagtgcagtggtac

SEQ ID NO: 14281 - DNA, 32 bp, Homo sapiens
actctgttgcccagactggagtgcagtggtgt

SEQ ID NO: 14282 - DNA, 32 bp, Homo sapiens
gctctgtcacccaggctggagtatagtggtgt

SEQ ID NO: 14283 - DNA, 32 bp, Homo sapiens
gctctgtcacccaggctggagtgcagtggtac

SEQ ID NO: 14284 - DNA, 32 bp, Homo sapiens
gctctgtcacctaggctagagtgcagtggtgc

SEQ ID NO: 14285 - DNA, 32 bp, Homo sapiens
cgggcactctcaggcaaccccacctccccctc

SEQ ID NO: 14286 - DNA, 32 bp, Homo sapiens
ccacatacagatggatgaaactacttactgat

SEQ ID NO: 14287 - DNA, 32 bp, Homo sapiens
atcataatggtagatccactggcagcttgcac

SEQ ID NO: 14288 - DNA, 32 bp, Homo sapiens
acccccgcctccagggttcaagtgattctcct

SEQ ID NO: 14289 - DNA, 32 bp, Homo sapiens
gatcctatcagcttctctcccacccaattagg

SEQ ID NO: 14290 - DNA, 32 bp, Homo sapiens
cgctctgtcaccaggctggagggcagtggtgc

SEQ ID NO: 14291 - DNA, 32 bp, Homo sapiens
gaaaataggttagaatctatggcttgattaaa

SEQ ID NO: 14292 - DNA, 24 bp, Homo sapiens
tcacctctgtaatcccagcacttt

SEQ ID NO: 14293 - DNA, 32 bp, Homo sapiens
agaagccaaagaggaggaggcaggagaagcag

SEQ ID NO: 14294 - DNA, 32 bp, Homo sapiens
agcctgagaagaggcagaggaagggcgaaaca

SEQ ID NO: 14295 - DNA, 21 bp, Homo sapiens
cctcgccccctcccctcgggc

SEQ ID NO: 14296 - DNA, 32 bp, Homo sapiens
tttgcccagctttctgtctggggcgcacggag

SEQ ID NO: 14297 - DNA, 24 bp, Homo sapiens
tcacgtctgtaatcccagcagttt

SEQ ID NO: 14298 - DNA, 32 bp, Homo sapiens
ccctgtgctcagggctggagagagggtggcgg

SEQ ID NO: 14299 - DNA, 32 bp, Homo sapiens
aatagggtattctgccccttgtttccacagct

SEQ ID NO: 14300 - DNA, 32 bp, Homo sapiens
agcaaaataatgaatggccactgtgaaaaatt

SEQ ID NO: 14301 - DNA, 32 bp, Homo sapiens
acctccacctcccaggttcaagcgattctcct

SEQ ID NO: 14302 - DNA, 32 bp, Homo sapiens
acctccgcctcccaagttcaagcgattctcct

SEQ ID NO: 14303 - DNA, 28 bp, Homo sapiens
gcttccccgagtgctgcctcctggtcaa

SEQ ID NO: 14304 - DNA, 32 bp, Homo sapiens
tgaaccgggaggcagaagttgcagtgagccga

SEQ ID NO: 14305 - DNA, 32 bp, Homo sapiens
gaacccggaaggcagagcttgcagtgagccga

SEQ ID NO: 14306 - DNA, 32 bp, Homo sapiens
gcgccgaggaggaagaggttgatggcggcggc

SEQ ID NO: 14307 - DNA, 32 bp, Homo sapiens
tcagagtcttctcctctctctgatctctgtgc

SEQ ID NO: 14308 - DNA, 32 bp, Homo sapiens
catcctggacaacaggagtgaaactccgtctc

SEQ ID NO: 14309 - DNA, 32 bp, Homo sapiens
acggtgtcacccagggtggaatacagtggtgt

SEQ ID NO: 14310 - DNA, 32 bp, Homo sapiens
tctcctcatcctgcttcacaggctccgcggcc

SEQ ID NO: 14311 - DNA, 24 bp, Homo sapiens
ctggtgtccaggctggagtgcagt

SEQ ID NO: 14312 - DNA, 32 bp, Homo sapiens
gattttggtgggaggaggagaaaacaattgtt

SEQ ID NO: 14313 - DNA, 24 bp, Homo sapiens
tgatgcaatcttggctcaccgcag

SEQ ID NO: 14314 - DNA, 32 bp, Homo sapiens
ccataggacttaaaggtgatttggatgcgttg

SEQ ID NO: 14315 - DNA, 32 bp, Homo sapiens
taagctcatccctcccgtccgaggctagtttc

SEQ ID NO: 14316 - DNA, 32 bp, Homo sapiens
aaggtcaaacatcagtgagcaagctgtgtaca

SEQ ID NO: 14317 - DNA, 32 bp, Homo sapiens
gcattgagcactttatctcccacgactcagtg

SEQ ID NO: 14318 - DNA, 32 bp, Homo sapiens
ttgccatcaagcaaccctcattctcatgcctg

SEQ ID NO: 14319 - DNA, 32 bp, Homo sapiens
ggcctcccaaagtgctgggattagaagcgtga

SEQ ID NO: 14320 - DNA, 32 bp, Homo sapiens
ggagaagcctgagacaagccacagaacccctc

SEQ ID NO: 14321 - DNA, 32 bp, Homo sapiens
aatgtgattgcagctttttgccttcagccttt

SEQ ID NO: 14322 - DNA, 32 bp, Homo sapiens
aaacatcacttacgttctcccacccatagaca

SEQ ID NO: 14323 - DNA, 32 bp, Homo sapiens
ggacttctgctgctgccacctgcgccagccct

SEQ ID NO: 14324 - DNA, 19 bp, Homo sapiens
gccttctggccacccagag

SEQ ID NO: 14325 - DNA, 32 bp, Homo sapiens
gagagagccctctccatgcagggcagatggag

SEQ ID NO: 14326 - DNA, 32 bp, Homo sapiens
tcttgctgcccaggctagagtgcaatggtgcg

SEQ ID NO: 14327 - DNA, 32 bp, Homo sapiens
ctgttgaccatgaatttcttagcaataggaat

SEQ ID NO: 14328 - DNA, 32 bp, Homo sapiens
acccacagcccaggcagcgggtgtgtggagat

SEQ ID NO: 14329 - DNA, 32 bp, Homo sapiens
gagggagcagcggggagcttgcagtgaccaag

SEQ ID NO: 14330 - DNA, 32 bp, Homo sapiens
tcttgtgggtgacctggatgtgagacctggag

SEQ ID NO: 14331 - DNA, 32 bp, Homo sapiens
gggcccgggaggcagacctgccctaagggtga

SEQ ID NO: 14332 - DNA, 32 bp, Homo sapiens
gaacccaggaggcagagatcgcagtgagttga

SEQ ID NO: 14333 - DNA, 19 bp, Homo sapiens
gcccctgcctgtaataggt

SEQ ID NO: 14334 - DNA, 32 bp, Homo sapiens
gtatagaaagtatggaaaagaaaacagacagt

SEQ ID NO: 14335 - DNA, 32 bp, Homo sapiens
ggctggggcaggggagaaagacagcagactca

SEQ ID NO: 14336 - DNA, 32 bp, Homo sapiens
gtgagacagagtttcactcttgttgcccaggc

SEQ ID NO: 14337 - DNA, 32 bp, Homo sapiens
gtctggcctctttcactcagcacaattctttt

SEQ ID NO: 14338 - DNA, 32 bp, Homo sapiens
ttctctggtgtttgttgacttctgcctgtggg

SEQ ID NO: 14339 - DNA, 32 bp, Homo sapiens
tccgcactacctgaacattgtaatacagacaa

SEQ ID NO: 14340 - DNA, 32 bp, Homo sapiens
gggggagggggaggagaaggggcagttgtgac

SEQ ID NO: 14341 - DNA, 32 bp, Homo sapiens
tgagacaataatgagttaaatattttattgga

SEQ ID NO: 14342 - DNA, 32 bp, Homo sapiens
attctgtctcgcaggccagagtgcagtggtgt

SEQ ID NO: 14343 - DNA, 32 bp, Homo sapiens
cttccaccaggagtctggagtgcaatggcacg

SEQ ID NO: 14344 - DNA, 32 bp, Homo sapiens
gggcaacatctccagcaatctgatctccttca

SEQ ID NO: 14345 - DNA, 32 bp, Homo sapiens
attgtagcctccatacagtggggtcttctctg

SEQ ID NO: 14346 - DNA, 32 bp, Homo sapiens
ccaaggtccctcaggctggttgtgaaatcagt

SEQ ID NO: 14347 - DNA, 32 bp, Homo sapiens
actctgtcacccaggctggagtgcagtgtcac

SEQ ID NO: 14348 - DNA, 32 bp, Homo sapiens
ttggcctcaagggatcctcccacctcggcttc

SEQ ID NO: 14349 - DNA, 32 bp, Homo sapiens
ggctgcttcttcaagcaaaccacctcaccaca

SEQ ID NO: 14350 - DNA, 32 bp, Homo sapiens
gcccactgtgtcctgaatgtttttgttatttt

SEQ ID NO: 14351 - DNA, 32 bp, Homo sapiens
caggcttccagcctgtttcagagaccactagc

SEQ ID NO: 14352 - DNA, 32 bp, Homo sapiens
acaatgccatttctccccaccacggaaccttc

SEQ ID NO: 14353 - DNA, 28 bp, Homo sapiens
ttgggtcaaagtgctgcctttaatcgac

SEQ ID NO: 14354 - DNA, 32 bp, Homo sapiens
gtgtgttcagccagactgggcaggtgcagtct

SEQ ID NO: 14355 - DNA, 32 bp, Homo sapiens
gaacttgtggggtggaggttgcagtgagctga

SEQ ID NO: 14356 - DNA, 32 bp, Homo sapiens
tctctctgtaccatgagctcctccaggagatt

SEQ ID NO: 14357 - DNA, 32 bp, Homo sapiens
ccctccgtctctcgggttcaagcaattgtctg

SEQ ID NO: 14358 - DNA, 32 bp, Homo sapiens
gacagagactgcaggggtccactgtgagaggt

SEQ ID NO: 14359 - DNA, 32 bp, Homo sapiens
gaacctgggaggcagaggttgcagggaaccta

SEQ ID NO: 14360 - DNA, 32 bp, Homo sapiens
ctactcgggaggctgaggtgggaggatcgctt

SEQ ID NO: 14361 - DNA, 32 bp, Homo sapiens
tgctgggtgatctctaggacccaggagcagag

SEQ ID NO: 14362 - DNA, 32 bp, Homo sapiens
acagggaaagagagagaaagaacaagctttct

SEQ ID NO: 14363 - DNA, 32 bp, Homo sapiens
ttgcgtagccctgggagccaccttgcttctgg

SEQ ID NO: 14364 - DNA, 32 bp, Homo sapiens
ctctgttgcccaggctggtgtgtagtgatctc

SEQ ID NO: 14365 - DNA, 32 bp, Homo sapiens
cgaaggtctgcagcttcactcctgagccagcc

SEQ ID NO: 14366 - DNA, 20 bp, Homo sapiens
ggggctgagagagatggggg

SEQ ID NO: 14367 - DNA, 32 bp, Homo sapiens
gagcccgggaggcggagcttgcagtgagctga

SEQ ID NO: 14368 - DNA, 32 bp, Homo sapiens
gggcccaggagtttgaggctgcagtgagccat

SEQ ID NO: 14369 - DNA, 28 bp, Homo sapiens
tttccctcttccgctgcctcattccttt

SEQ ID NO: 14370 - DNA, 32 bp, Homo sapiens
tgagaaagaagaggaagataaagatgacgaag

SEQ ID NO: 14371 - DNA, 32 bp, Homo sapiens
ttgaaaaggagtttcgctcttgtccaggctgg

SEQ ID NO: 14372 - DNA, 21 bp, Homo sapiens
gttttgacgtctttttacttg

SEQ ID NO: 14373 - DNA, 32 bp, Homo sapiens
acctccgcctcccaagttcaagcgattgtcct

SEQ ID NO: 14374 - DNA, 28 bp, Homo sapiens
ggcacgaggctgcctcagtctcctgagt

SEQ ID NO: 14375 - DNA, 32 bp, Homo sapiens
gcataaaatgttcctggtcggggcttggaaga

SEQ ID NO: 14376 - DNA, 32 bp, Homo sapiens
gatgttcaacatcagtttacttgcagctggaa

SEQ ID NO: 14377 - DNA, 32 bp, Homo sapiens
cttaattagagatgatttctggaacattcagt

SEQ ID NO: 14378 - DNA, 18 bp, Homo sapiens
atttcaactagcttctga

SEQ ID NO: 14379 - DNA, 32 bp, Homo sapiens
catcttctcttcctcttccccaccgtcctctc

SEQ ID NO: 14380 - DNA, 23 bp, Homo sapiens
tcacacctgtgatcccagcactt

SEQ ID NO: 14381 - DNA, 32 bp, Homo sapiens
gctctgtcaccaggctggagtgcggtggcata

SEQ ID NO: 14382 - DNA, 32 bp, Homo sapiens
gctctgtcaccaggctggagtgcagtggcatg

SEQ ID NO: 14383 - DNA, 32 bp, Homo sapiens
tatagcttgctgctgctcaccttttggtccac

SEQ ID NO: 14384 - DNA, 32 bp, Homo sapiens
gcatcatcctcgggagctgacaacagccaggc

SEQ ID NO: 14385 - DNA, 32 bp, Homo sapiens
agctccgcctcctgggttcaagcgattctcct

SEQ ID NO: 14386 - DNA, 32 bp, Homo sapiens
acctccacctcctgggttcaagcgattctctt

SEQ ID NO: 14387 - DNA, 28 bp, Homo sapiens
aaactcccaagtgtgttcttatcccatg

SEQ ID NO: 14388 - DNA, 32 bp, Homo sapiens
gggcccgggaggcagaggttgcagtgagccga

SEQ ID NO: 14389 - DNA, 32 bp, Homo sapiens
cgtgtcctactcatctgctcccacggatgacc

SEQ ID NO: 14390 - DNA, 32 bp, Homo sapiens
acctccacctcctgggttcaagtgattctcct

SEQ ID NO: 14391 - DNA, 32 bp, Homo sapiens
gtaggcccaagtgtcaagaaccacaccagatt

SEQ ID NO: 14392 - DNA, 32 bp, Homo sapiens
gaacccagaaggtggaggttgcagtgagccga

SEQ ID NO: 14393 - DNA, 32 bp, Homo sapiens
aaacccaggaggtggaggttgcagtgagccga

SEQ ID NO: 14394 - DNA, 32 bp, Homo sapiens
cggttgactgagaccggtctgtggctgtgggc

SEQ ID NO: 14395 - DNA, 32 bp, Homo sapiens
ctcttgtctccccggctggagtgcagtggcat

SEQ ID NO: 14396 - DNA, 32 bp, Homo sapiens
cctgtcagtcctatactggagtcctgttaata

SEQ ID NO: 14397 - DNA, 32 bp, Homo sapiens
gagaacatccttctccctcagctggagggagc

SEQ ID NO: 14398 - DNA, 22 bp, Homo sapiens
atgcctgtaatcccagtacttt

SEQ ID NO: 14399 - DNA, 32 bp, Homo sapiens
ttacaatcaacctgcactgagcactttgtgcg

SEQ ID NO: 14400 - DNA, 32 bp, Homo sapiens
ccgcttgtgctgcagccatgtctctagtgatc

SEQ ID NO: 14401 - DNA, 32 bp, Homo sapiens
ttaatctctgcagtttattctctcttaaggaa

SEQ ID NO: 14402 - DNA, 32 bp, Homo sapiens
gctctgcctgcagctgggcctctgcctcatcc

SEQ ID NO: 14403 - DNA, 32 bp, Homo sapiens
ctgttgttgcccaggctggagtgcagtggcgt

SEQ ID NO: 14404 - DNA, 32 bp, Homo sapiens
tctgtgtcacccactcctgggtgcgtgcagac

SEQ ID NO: 14405 - DNA, 32 bp, Homo sapiens
gccctcccaagtgcagctgcagccacccaagc

SEQ ID NO: 14406 - DNA, 32 bp, Homo sapiens
ccgggttcaggcaattctcctgcctcagcttc

SEQ ID NO: 14407 - DNA, 32 bp, Homo sapiens
tcaaaaagtttaaaaagggaattctttagaga

SEQ ID NO: 14408 - DNA, 32 bp, Homo sapiens
actttgtcccccaggctggagtgcagtggtac

SEQ ID NO: 14409 - DNA, 32 bp, Homo sapiens
tactcatatcttctctaatttggtcctgatac

SEQ ID NO: 14410 - DNA, 18 bp, Homo sapiens
gcctctcctattcaggta

SEQ ID NO: 14411 - DNA, 17 bp, Homo sapiens
gcccctgctccaccagg

SEQ ID NO: 14412 - DNA, 24 bp, Homo sapiens
ctgctggctgtgtccatgcaggtg

SEQ ID NO: 14413 - DNA, 32 bp, Homo sapiens
tgagcagacctggctcaccacagggtcctact

SEQ ID NO: 14414 - DNA, 32 bp, Homo sapiens
ttagcaggagcagatttttcccagaagctgct

SEQ ID NO: 14415 - DNA, 32 bp, Homo sapiens
ctcttgtctcccagactggactgcagtggcac

SEQ ID NO: 14416 - DNA, 32 bp, Homo sapiens
ctgggttcaagcaattctctgcctcagcctcc

SEQ ID NO: 14417 - DNA, 32 bp, Homo sapiens
ctgagttcaagcaatccttctgtctcagtctc

SEQ ID NO: 14418 - DNA, 32 bp, Homo sapiens
tttgtactcaccaggctggagtgtggtagcac

SEQ ID NO: 14419 - DNA, 32 bp, Homo sapiens
acccaccccaaaatgaccttggccacctgtct

SEQ ID NO: 14420 - DNA, 32 bp, Homo sapiens
gggggtactgatctttggaaatgtcagtcctg

SEQ ID NO: 14421 - DNA, 32 bp, Homo sapiens
tgtccccacctcctccccatgggcaccatctc

SEQ ID NO: 14422 - DNA, 32 bp, Homo sapiens
agaatcctgaggacctggagtgcaatgagaat

SEQ ID NO: 14423 - DNA, 23 bp, Homo sapiens
tggcatgatctcggctcattgca

SEQ ID NO: 14424 - DNA, 24 bp, Homo sapiens
ccttcaggaagccccagaacaccc

SEQ ID NO: 14425 - DNA, 32 bp, Homo sapiens
gaattggggaggcggaggttgcagtgagctga

SEQ ID NO: 14426 - DNA, 32 bp, Homo sapiens
tgtgacccaagtggcccggaccagtttggggc

SEQ ID NO: 14427 - DNA, 32 bp, Homo sapiens
tcatccactcaggtcttcctctggacctgcat

SEQ ID NO: 14428 - DNA, 32 bp, Homo sapiens
gatgctagaagagctgaacaaacagatcgagg

SEQ ID NO: 14429 - DNA, 32 bp, Homo sapiens
ctgtcttcaacaacaggtgctgcttagtcatt

SEQ ID NO: 14430 - DNA, 32 bp, Homo sapiens
ggttctcagctttccttaagcgacccagcagc

SEQ ID NO: 14431 - DNA, 32 bp, Homo sapiens
attctggtgatctactgcacaggatggtagcc

SEQ ID NO: 14432 - DNA, 32 bp, Homo sapiens
gctcaggcgcttctcccaccttggcctcctga

SEQ ID NO: 14433 - DNA, 32 bp, Homo sapiens
gtcctaaagcctttgccattcctaatactcgt

SEQ ID NO: 14434 - DNA, 22 bp, Homo sapiens
ggcacgatctcggctcaccgca

SEQ ID NO: 14435 - DNA, 32 bp, Homo sapiens
tggtctgtgcttggtttaacagctccaacaat

SEQ ID NO: 14436 - DNA, 32 bp, Homo sapiens
gactgaagcacctgctccgccatgaacctgcc

SEQ ID NO: 14437 - DNA, 32 bp, Homo sapiens
actccgtagcccaggctggagtgcagtggcac

SEQ ID NO: 14438 - DNA, 32 bp, Homo sapiens
gaacccggcaggaagaggttgcattgagctga

SEQ ID NO: 14439 - DNA, 32 bp, Homo sapiens
cctttcgggaggctgagacaggagaatcgctt

SEQ ID NO: 14440 - DNA, 32 bp, Homo sapiens
gctctgttgctgaggctggagtgcagtgatgt

SEQ ID NO: 14441 - DNA, 32 bp, Homo sapiens
gctctgtcacccagtttggagtgcagtggtgc

SEQ ID NO: 14442 - DNA, 32 bp, Homo sapiens
gctccgtcacccaggctggagtgcagtggcaa

SEQ ID NO: 14443 - DNA, 32 bp, Homo sapiens
cagcctcctggtagctgggactacagcttcct

SEQ ID NO: 14444 - DNA, 32 bp, Homo sapiens
tccttgtgtgtgtcttggagtgcatttgactc

SEQ ID NO: 14445 - DNA, 32 bp, Homo sapiens
gctctgtcacccagtctggagtgcagtggtgt

SEQ ID NO: 14446 - DNA, 31 bp, Homo sapiens
catccagacagcaaagcaaggagggagcgtg

SEQ ID NO: 14447 - DNA, 24 bp, Homo sapiens
tcacacctgtaatcccagcatttt

SEQ ID NO: 14448 - DNA, 24 bp, Homo sapiens
tcacacctgtaaccccagcacttt

SEQ ID NO: 14449 - DNA, 32 bp, Homo sapiens
tatgttggtgtgtttgtccttacttgaaatgg

SEQ ID NO: 14450 - DNA, 32 bp, Homo sapiens
gtagagtattttaatcctattacttgactaag

SEQ ID NO: 14451 - DNA, 32 bp, Homo sapiens
tttaaggtgatctcattgatggtagttctcag

SEQ ID NO: 14452 - DNA, 32 bp, Homo sapiens
gcaagaggccaaggctggagaggcgtgccagc

SEQ ID NO: 14453 - DNA, 32 bp, Homo sapiens
catttactagttctgtaaaatcaaagatacta

SEQ ID NO: 14454 - DNA, 32 bp, Homo sapiens
tttgagacgagtttcgctctgttgcccaggct

SEQ ID NO: 14455 - DNA, 28 bp, Homo sapiens
ctcacttccaatgctgccttgatctctg

SEQ ID NO: 14456 - DNA, 32 bp, Homo sapiens
aaaagaataaagacattcctggaatcactcct

SEQ ID NO: 14457 - DNA, 32 bp, Homo sapiens
gtaagacttgacctttatctggaacactcctt

SEQ ID NO: 14458 - DNA, 32 bp, Homo sapiens
tgtggtgtgagtgacttcctgcaccatcatct

SEQ ID NO: 14459 - DNA, 32 bp, Homo sapiens
ggggcaggaagaggagcagaaaagaagggctg

SEQ ID NO: 14460 - DNA, 32 bp, Homo sapiens
aggctcccaagtagctgggattacaggtgccc

SEQ ID NO: 14461 - DNA, 32 bp, Homo sapiens
ttttctgaagaaacccacccactgtgatcaat

SEQ ID NO: 14462 - DNA, 32 bp, Homo sapiens
actacccacgtagtgaatcttttgtctgcaat

SEQ ID NO: 14463 - DNA, 32 bp, Homo sapiens
gagctttccagccgtgttgtagctaattagga

SEQ ID NO: 14464 - DNA, 32 bp, Homo sapiens
ccacttccaccccttggtatctggacccacgt

SEQ ID NO: 14465 - DNA, 32 bp, Homo sapiens
ccaaacccaagtgtccaaggctccagtcctag

SEQ ID NO: 14466 - DNA, 32 bp, Homo sapiens
gaacctgggaggcagaggttgccgtgagctga

SEQ ID NO: 14467 - DNA, 32 bp, Homo sapiens
atggcatgtaccacctgtcctaggaagaccag

SEQ ID NO: 14468 - DNA, 32 bp, Homo sapiens
ccgggttcaagcagttctgcctcagcctccca

SEQ ID NO: 14469 - DNA, 32 bp, Homo sapiens
ccgccatcgtcccggctgaagtgcagtggcac

SEQ ID NO: 14470 - DNA, 32 bp, Homo sapiens
caacttcagtccgggctggaggccgtgcacaa

SEQ ID NO: 14471 - DNA, 32 bp, Homo sapiens
tggtctgactgcactgtctccatcttatgcaa

SEQ ID NO: 14472 - DNA, 32 bp, Homo sapiens
tctaaaacccttcatccaatggtgctaacccc

SEQ ID NO: 14473 - DNA, 32 bp, Homo sapiens
ttagtaagttgctgatttatggtgctaaagaa

SEQ ID NO: 14474 - DNA, 24 bp, Homo sapiens
tcatgcctatagtcccagcacttt

SEQ ID NO: 14475 - DNA, 24 bp, Homo sapiens
tcatgcctataatcccagcgcttt

SEQ ID NO: 14476 - DNA, 32 bp, Homo sapiens
ctactgcagaaggaagaaagaatataatatga

SEQ ID NO: 14477 - DNA, 24 bp, Homo sapiens
tggcagtgtcatggctcactgcag

SEQ ID NO: 14478 - DNA, 32 bp, Homo sapiens
ctccaggctctctcttctccagggcaccaaga

SEQ ID NO: 14479 - DNA, 32 bp, Homo sapiens
ccccagtattgtagagcaagtcttgtgttaaa

SEQ ID NO: 14480 - DNA, 21 bp, Homo sapiens
gttaatgtggatgtagtgctt

SEQ ID NO: 14481 - DNA, 32 bp, Homo sapiens
cctatctggagtttggccttgttaacctagta

SEQ ID NO: 14482 - DNA, 32 bp, Homo sapiens
atgtcatggagtttagtccttgtttcaggttt

SEQ ID NO: 14483 - DNA, 32 bp, Homo sapiens
acctctgcctcctgggtgcaagcaattatcct

SEQ ID NO: 14484 - DNA, 32 bp, Homo sapiens
cagcacccaagtgccctcccctcacagtgtca

SEQ ID NO: 14485 - DNA, 32 bp, Homo sapiens
aaaaattcaagcacttcttccctccaccctca

SEQ ID NO: 14486 - DNA, 32 bp, Homo sapiens
tcaccgtcccccaggctggagtgccgtggcgt

SEQ ID NO: 14487 - DNA, 32 bp, Homo sapiens
actctgtttcccaggctggagtgcacaaacat

SEQ ID NO: 14488 - DNA, 21 bp, Homo sapiens
cagggaagcactgcccagccc

SEQ ID NO: 14489 - DNA, 32 bp, Homo sapiens
tgtctgctgctgctgtccgagcttcacaatgc

SEQ ID NO: 14490 - DNA, 32 bp, Homo sapiens
agacctcagcttctccctctgaacttcaagtc

SEQ ID NO: 14491 - DNA, 32 bp, Homo sapiens
ccacgttggccaggctggtcttaaatgaccct

SEQ ID NO: 14492 - DNA, 32 bp, Homo sapiens
ctctgtcacccaggctgcagtgtagtggtgca

SEQ ID NO: 14493 - DNA, 32 bp, Homo sapiens
tcacactctccaggctggagtgcagtggcaca

SEQ ID NO: 14494 - DNA, 32 bp, Homo sapiens
tcaaatcaacatctttctggataaatctattt

SEQ ID NO: 14495 - DNA, 32 bp, Homo sapiens
tcctgtctttctggccctttctggaccagatc

SEQ ID NO: 14496 - DNA, 32 bp, Homo sapiens
actatattgtccaggctagagtgcagtggcta

SEQ ID NO: 14497 - DNA, 32 bp, Homo sapiens
gaacccgggaggcggaggttgcatgagctgag

SEQ ID NO: 14498 - DNA, 32 bp, Homo sapiens
ggatggagcccaggcgggagcggtggccctgt

SEQ ID NO: 14499 - DNA, 21 bp, Homo sapiens
gacaaaaaagacattccctca

SEQ ID NO: 14500 - DNA, 32 bp, Homo sapiens
aaattagtagttacctgtaaatggcagatctt

SEQ ID NO: 14501 - DNA, 32 bp, Homo sapiens
gaacccgggaggaagagcttgcagtgagccga

SEQ ID NO: 14502 - DNA, 32 bp, Homo sapiens
gaacctgggaggcggaggttgcagtgagcgag

SEQ ID NO: 14503 - DNA, 32 bp, Homo sapiens
gggactatgatctcctggtggtcggcggggga

SEQ ID NO: 14504 - DNA, 16 bp, Homo sapiens
gcccctgccctcggtg

SEQ ID NO: 14505 - DNA, 32 bp, Homo sapiens
gctctgtagaccaggctggagcgcagtggcag

SEQ ID NO: 14506 - DNA, 32 bp, Homo sapiens
ctctgttgcccaggctggagtgcagggacacc

SEQ ID NO: 14507 - DNA, 32 bp, Homo sapiens
ttgaggcagagttttgctcttgttgcccaggc

SEQ ID NO: 14508 - DNA, 32 bp, Homo sapiens
ccggtggcccttgcttcttgctttgcagactg

SEQ ID NO: 14509 - DNA, 32 bp, Homo sapiens
gaacctgcgaggcagagattgcagtgagccaa

SEQ ID NO: 14510 - DNA, 32 bp, Homo sapiens
acctccgcctcctgggttcgggtgattctcct

SEQ ID NO: 14511 - DNA, 32 bp, Homo sapiens
actctttcgcccaggctggagtgcagtggtat

SEQ ID NO: 14512 - DNA, 32 bp, Homo sapiens
agcaccaagcggtggtggctgtggaggaagcc

SEQ ID NO: 14513 - DNA, 32 bp, Homo sapiens
gccgtgtgtgttcttctctgagcagctcctcc

SEQ ID NO: 14514 - DNA, 22 bp, Homo sapiens
ttgagtctgacccaggacctct

SEQ ID NO: 14515 - DNA, 32 bp, Homo sapiens
tctagaggaagaggaggacgacaggccatacg

SEQ ID NO: 14516 - DNA, 32 bp, Homo sapiens
gaggtagagtcagagtagggaaaacaactaat

SEQ ID NO: 14517 - DNA, 32 bp, Homo sapiens
tgcagacctcaaggaggctccctagcaacagc

SEQ ID NO: 14518 - DNA, 32 bp, Homo sapiens
caagagaaaagccatcatattacttgggatct

SEQ ID NO: 14519 - DNA, 24 bp, Homo sapiens
ttcattggtgaggatttcctttga

SEQ ID NO: 14520 - DNA, 32 bp, Homo sapiens
tccacagtgctgctaatatcccagctccagcc

SEQ ID NO: 14521 - DNA, 32 bp, Homo sapiens
gagattgtgctgctgcactccagcctgggaga

SEQ ID NO: 14522 - DNA, 32 bp, Homo sapiens
aggcgttcctcagagtcacagggaatggcggc

SEQ ID NO: 14523 - DNA, 21 bp, Homo sapiens
gcaagatttcggctcactgca

SEQ ID NO: 14524 - DNA, 23 bp, Homo sapiens
ggcacggacaagggccactgcag

SEQ ID NO: 14525 - DNA, 32 bp, Homo sapiens
aacaatgtgctgctgcttcacttccgccctcc

SEQ ID NO: 14526 - DNA, 32 bp, Homo sapiens
ttgagacagagttttgctcttgttgcccaggc

SEQ ID NO: 14527 - DNA, 32 bp, Homo sapiens
ttgagatggagtttcactcttgttgcccaggc

SEQ ID NO: 14528 - DNA, 32 bp, Homo sapiens
ttgaggtggagtttcactcttgttgcccaagc

SEQ ID NO: 14529 - DNA, 32 bp, Homo sapiens
gcatcttcacctgaattcttcaatgccagggt

SEQ ID NO: 14530 - DNA, 32 bp, Homo sapiens
cttataagaagaggaaaagacacaaggaatgt

SEQ ID NO: 14531 - DNA, 32 bp, Homo sapiens
aaatgcagtacatttgaaaatttttagattat

SEQ ID NO: 14532 - DNA, 32 bp, Homo sapiens
acagacaggatggacttcctccggctatacct

SEQ ID NO: 14533 - DNA, 32 bp, Homo sapiens
acttccacctcccgggttcaagcgatcctgcc

SEQ ID NO: 14534 - DNA, 32 bp, Homo sapiens
ctggcactcaggcaactggagtaagtgctccc

SEQ ID NO: 14535 - DNA, 32 bp, Homo sapiens
ttgacctcaggtgatctgcccacctcggcctc

SEQ ID NO: 14536 - DNA, 32 bp, Homo sapiens
ctgacctcaaatgatccacccacctcagcctc

SEQ ID NO: 14537 - DNA, 32 bp, Homo sapiens
caggggagagagtgagcgtgagcttggcatag

SEQ ID NO: 14538 - DNA, 24 bp, Homo sapiens
agtgcagggagttgaacttttgga

SEQ ID NO: 14539 - DNA, 32 bp, Homo sapiens
ctgacctcaggtgatccgcccacctcggcctc

SEQ ID NO: 14540 - DNA, 32 bp, Homo sapiens
ctgacctcaagtgatccacccacctcggcctc

SEQ ID NO: 14541 - DNA, 32 bp, Homo sapiens
gctgctggtgtttggcttattgacatactcca

SEQ ID NO: 14542 - DNA, 32 bp, Homo sapiens
cctggtgtgctgcgtgctcgcaaccacagatg

SEQ ID NO: 14543 - DNA, 32 bp, Homo sapiens
tctccaacatctctccccacctcatgattgtc

SEQ ID NO: 14544 - DNA, 32 bp, Homo sapiens
tttagcattagtccatttctgctgctaacaat

SEQ ID NO: 14545 - DNA, 32 bp, Homo sapiens
tcatcacatcttctctggccctcgactgagat

SEQ ID NO: 14546 - DNA, 24 bp, Homo sapiens
tcatgactgtaatcccagcacttt

SEQ ID NO: 14547 - DNA, 32 bp, Homo sapiens
gcacccaatttccaaaagacatttcatgaaac

SEQ ID NO: 14548 - DNA, 18 bp, Homo sapiens
cagggcatcctccagctc

SEQ ID NO: 14549 - DNA, 32 bp, Homo sapiens
cccctccctcaaggaggtctggctttatccat

SEQ ID NO: 14550 - DNA, 24 bp, Homo sapiens
ctgccacccaagctggagtgcagt

SEQ ID NO: 14551 - DNA, 32 bp, Homo sapiens
ctctgttgcccagcctggagtgcagtgtgtca

SEQ ID NO: 14552 - DNA, 32 bp, Homo sapiens
ctctttttgcacaggctgagtgcaatgccgtg

SEQ ID NO: 14553 - DNA, 29 bp, Homo sapiens
gctgtgacagttctgttggtctacagaaa

SEQ ID NO: 14554 - DNA, 32 bp, Homo sapiens
actctctcgcccaggctggagtgcaacggtac

SEQ ID NO: 14555 - DNA, 32 bp, Homo sapiens
gaacccgggaggtggagattgcagtgagccca

SEQ ID NO: 14556 - DNA, 32 bp, Homo sapiens
cccggtcagccaatctgggtgctgctgacgtg

SEQ ID NO: 14557 - DNA, 32 bp, Homo sapiens
agcctcctgagtagctgggattacagaaaatc

SEQ ID NO: 14558 - DNA, 32 bp, Homo sapiens
agcctcctgagtagctgggataacaggtgtgg

SEQ ID NO: 14559 - DNA, 32 bp, Homo sapiens
gctctgtcacccaggctggagtacaatagcgt

SEQ ID NO: 14560 - DNA, 32 bp, Homo sapiens
atggagaaattcaggctgggtgcagtggctca

SEQ ID NO: 14561 - DNA, 32 bp, Homo sapiens
ttctgagatcatgcatctcccacccatctgcc

SEQ ID NO: 14562 - DNA, 32 bp, Homo sapiens
taagccaggcctgggtgtctggagtttgtgaa

SEQ ID NO: 14563 - DNA, 32 bp, Homo sapiens
gcctccacctcccaggttcaagcaattctcgt

SEQ ID NO: 14564 - DNA, 32 bp, Homo sapiens
ctctgcctggagcccaggttgcaggtggtgag

SEQ ID NO: 14565 - DNA, 32 bp, Homo sapiens
acccttaaacatcagtagactgggagctgtac

SEQ ID NO: 14566 - DNA, 32 bp, Homo sapiens
cccaagcttaccacctgcacccggagagctgt

SEQ ID NO: 14567 - DNA, 32 bp, Homo sapiens
gagcccaggaggcggagattgcagtgagccga

SEQ ID NO: 14568 - DNA, 32 bp, Homo sapiens
gggcccgggaggtggaggttgcagtgagtcaa

SEQ ID NO: 14569 - DNA, 32 bp, Homo sapiens
gggttgtgggggcagagggggtctgtgaatct

SEQ ID NO: 14570 - DNA, 32 bp, Homo sapiens
actctgttgcccaagctggagtacagtagtgc

SEQ ID NO: 14571 - DNA, 32 bp, Homo sapiens
gagctcggaagatggaggctgcagtgagccat

SEQ ID NO: 14572 - DNA, 32 bp, Homo sapiens
gaccccgggaggtggaggctgcagtgagttgt

SEQ ID NO: 14573 - DNA, 32 bp, Homo sapiens
agccttctgagtagctgggagtacaggcgccc

SEQ ID NO: 14574 - DNA, 32 bp, Homo sapiens
agcctcctgagtagctgggattacaggcagac

SEQ ID NO: 14575 - DNA, 32 bp, Homo sapiens
tgttcaaatgttccttttaacggatggttgaa

SEQ ID NO: 14576 - DNA, 32 bp, Homo sapiens
aacttcagtccgggctggaggccgtgcacaac

SEQ ID NO: 14577 - DNA, 32 bp, Homo sapiens
ctggaccagtggtctcacatggtgctacgcct

SEQ ID NO: 14578 - DNA, 32 bp, Homo sapiens
agccttccgagtagctgggattacaggctcct

SEQ ID NO: 14579 - DNA, 32 bp, Homo sapiens
agggagggatggcaggcttcagccacttctcc

SEQ ID NO: 14580 - DNA, 32 bp, Homo sapiens
acctccgcctcctgggttcaagcgattcctgt

SEQ ID NO: 14581 - DNA, 28 bp, Homo sapiens
tcttccctgtctgctgcctctccagtcc

SEQ ID NO: 14582 - DNA, 32 bp, Homo sapiens
agccttccgagtagctgggattacaggtgtgt

SEQ ID NO: 14583 - DNA, 32 bp, Homo sapiens
agcctcctgagtagctgggattacaggtgcgc

SEQ ID NO: 14584 - DNA, 32 bp, Homo sapiens
tttcttctctcaacaggaacctgcctgaggac

SEQ ID NO: 14585 - DNA, 32 bp, Homo sapiens
gaggactctgcagtaccttctcctacatctag

SEQ ID NO: 14586 - DNA, 32 bp, Homo sapiens
attttcttctgtgcttctctctatctgctctg

SEQ ID NO: 14587 - DNA, 32 bp, Homo sapiens
tctctacatcttctcttggagtgagggaggct

SEQ ID NO: 14588 - DNA, 32 bp, Homo sapiens
tctgttgccccaggctggagtgcagtggcgtg

SEQ ID NO: 14589 - DNA, 32 bp, Homo sapiens
ctctgccgcccaggcgggagtgcagtggcagt

SEQ ID NO: 14590 - DNA, 21 bp, Homo sapiens
ctgctgtttgttctgcaagtg

SEQ ID NO: 14591 - DNA, 32 bp, Homo sapiens
ctccagctctgctgcttcaacaacagtgactt

SEQ ID NO: 14592 - DNA, 32 bp, Homo sapiens
catctgtcacccaggctggtgtgcaggggtgc

SEQ ID NO: 14593 - DNA, 32 bp, Homo sapiens
ggcactgtgctgctgctgtggagcggcgccga

SEQ ID NO: 14594 - DNA, 22 bp, Homo sapiens
ctgcggcttgttgaggtgcaat

SEQ ID NO: 14595 - DNA, 32 bp, Homo sapiens
gctctgtctcccaggctggagcgtagtaatgc

SEQ ID NO: 14596 - DNA, 32 bp, Homo sapiens
ctctgtcgcccaggctggactgcagtggtgcg

SEQ ID NO: 14597 - DNA, 32 bp, Homo sapiens
ctgtgtcgcccaggctggagtgcagtggcgtg

SEQ ID NO: 14598 - DNA, 32 bp, Homo sapiens
ttcgccattgcatctactctttgctgcacaca

SEQ ID NO: 14599 - DNA, 32 bp, Homo sapiens
gagcccaggaggcggagcttgcagtgagtcga

SEQ ID NO: 14600 - DNA, 28 bp, Homo sapiens
agggccccaagtgtctgactcgcaaagg

SEQ ID NO: 14601 - DNA, 28 bp, Homo sapiens
tgcctttccagtgctgctccctttatca

SEQ ID NO: 14602 - DNA, 32 bp, Homo sapiens
ctttgctttggctgtcgtcttctgccgtgtgc

SEQ ID NO: 14603 - DNA, 19 bp, Homo sapiens
gccttctgcccgacccagg

SEQ ID NO: 14604 - DNA, 32 bp, Homo sapiens
tgccctctcgccaggctggagtgtagtggcac

SEQ ID NO: 14605 - DNA, 32 bp, Homo sapiens
cttcgtcttctgctgctgctcggctggaccag

SEQ ID NO: 14606 - DNA, 32 bp, Homo sapiens
gcagtccgcccatctgagcacagggtctgtcc

SEQ ID NO: 14607 - DNA, 32 bp, Homo sapiens
cctttgttcttttcctgccacagggtctttgc

SEQ ID NO: 14608 - DNA, 32 bp, Homo sapiens
aaggatgccactgttcttatctcctccaattt

SEQ ID NO: 14609 - DNA, 19 bp, Homo sapiens
cagggcgccctttcagccc

SEQ ID NO: 14610 - DNA, 20 bp, Homo sapiens
cagggtcagccttccagctc

SEQ ID NO: 14611 - DNA, 32 bp, Homo sapiens
gcctcgacttcctgggatccagcgatcctccc

SEQ ID NO: 14612 - DNA, 32 bp, Homo sapiens
cccttctgaatcagctgggatgactggctttg

SEQ ID NO: 14613 - DNA, 32 bp, Homo sapiens
agtatattttgttctgaactggcagtttaaga

SEQ ID NO: 14614 - DNA, 32 bp, Homo sapiens
cgcttgttgcccaggctggagtgcaatggcgc

SEQ ID NO: 14615 - DNA, 32 bp, Homo sapiens
ctgggttcaagcaattcttgtgcctcagcctc

SEQ ID NO: 14616 - DNA, 32 bp, Homo sapiens
aggctcctgagtagctggggattacaggtgcc

SEQ ID NO: 14617 - DNA, 32 bp, Homo sapiens
agcctcccgagtagctgggattgcaggtaccc

SEQ ID NO: 14618 - DNA, 32 bp, Homo sapiens
atagaagaccagaaaggcgaccaccttgtgaa

SEQ ID NO: 14619 - DNA, 23 bp, Homo sapiens
tcaagcctataatcccagcactt

SEQ ID NO: 14620 - DNA, 32 bp, Homo sapiens
ttgacctcgggtgatccacccacctcagcctc

SEQ ID NO: 14621 - DNA, 32 bp, Homo sapiens
gagaccggagtcttgctcttgtcgcctcctga

SEQ ID NO: 14622 - DNA, 32 bp, Homo sapiens
cgcagggcctgctcttcttccggcaggaccag

SEQ ID NO: 14623 - DNA, 24 bp, Homo sapiens
gtcgcccaggctggagtgcagtga

SEQ ID NO: 14624 - DNA, 32 bp, Homo sapiens
ttactggggagaatagaaagaaaacaattgac

SEQ ID NO: 14625 - DNA, 32 bp, Homo sapiens
aagaatgaatcttctgaaaatattttaagtga

SEQ ID NO: 14626 - DNA, 32 bp, Homo sapiens
tttgagatggagtctcgctttgttgcccagac

SEQ ID NO: 14627 - DNA, 32 bp, Homo sapiens
cccacacttaaccttgtcaataggttcttgaa

SEQ ID NO: 14628 - DNA, 32 bp, Homo sapiens
accggtggtgctggtctgcctttgccaactat

SEQ ID NO: 14629 - DNA, 32 bp, Homo sapiens
cagctttcaagtgcctttctgcagtttttcag

SEQ ID NO: 14630 - DNA, 32 bp, Homo sapiens
catccttgcccagccggtgtggtgcttgtgtg

SEQ ID NO: 14631 - DNA, 32 bp, Homo sapiens
ggcaggtgtctgctgctcacctggctctggag

SEQ ID NO: 14632 - DNA, 21 bp, Homo sapiens
caggagcctggggcctgtgga

SEQ ID NO: 14633 - DNA, 32 bp, Homo sapiens
aacctcctgagtagctgggactgcaggcacgc

SEQ ID NO: 14634 - DNA, 32 bp, Homo sapiens
gggacgtcacccaaggctggtggtcagtgtga

SEQ ID NO: 14635 - DNA, 32 bp, Homo sapiens
gagcccaggaggtcaaggctgcagtgagcttt

SEQ ID NO: 14636 - DNA, 32 bp, Homo sapiens
ctgagctcaagcaattctcatgcctcagcctc

SEQ ID NO: 14637 - DNA, 32 bp, Homo sapiens
cacagctacaggctttctacttaacttctggg

SEQ ID NO: 14638 - DNA, 32 bp, Homo sapiens
cagctcccaagtagctgggattacaggcatgt

SEQ ID NO: 14639 - DNA, 32 bp, Homo sapiens
gcattatgtctgttgctcacagatgcagagac

SEQ ID NO: 14640 - DNA, 32 bp, Homo sapiens
tcctcagagccagcttctcctctcaatgtctg

SEQ ID NO: 14641 - DNA, 32 bp, Homo sapiens
gagagaagaagaggaagaagaggaggcggcgg

SEQ ID NO: 14642 - DNA, 32 bp, Homo sapiens
ttgttaagatggcttgaaaagtttcattttat

SEQ ID NO: 14643 - DNA, 32 bp, Homo sapiens
cacaggcagcgctttgtaaactgtgaagccat

SEQ ID NO: 14644 - DNA, 32 bp, Homo sapiens
gtcgaatggagttttgatctcgctgagtttgg

SEQ ID NO: 14645 - DNA, 32 bp, Homo sapiens
ttctgtcgcccaggctggagtgtagtgacgcg

SEQ ID NO: 14646 - DNA, 32 bp, Homo sapiens
actcctagcttttgctaaaatatggttggcac

SEQ ID NO: 14647 - DNA, 32 bp, Homo sapiens
caagagagaagaggaggagaagggagggggtg

SEQ ID NO: 14648 - DNA, 32 bp, Homo sapiens
cctcgaactcttgggcttcaagcaatcctcct

SEQ ID NO: 14649 - DNA, 32 bp, Homo sapiens
gtctcaaactcctgggttcaagtgatcattcc

SEQ ID NO: 14650 - DNA, 31 bp, Homo sapiens
atggcaatatacatggagaggagggactctt

SEQ ID NO: 14651 - DNA, 32 bp, Homo sapiens
cagaaaccaaatcagtcttctataatctgggg

SEQ ID NO: 14652 - DNA, 32 bp, Homo sapiens
tccgcagtggctgctttcctggaagacgtttc

SEQ ID NO: 14653 - DNA, 32 bp, Homo sapiens
ctggtgctgctgctgggtggctgctccgggcg

SEQ ID NO: 14654 - DNA, 17 bp, Homo sapiens
gcagaaagatgctctcc

SEQ ID NO: 14655 - DNA, 32 bp, Homo sapiens
agaatccccaaaagtgtcatgcttttaaacaa

SEQ ID NO: 14656 - DNA, 32 bp, Homo sapiens
agtggttggccaggctgcagtataactgaagc

SEQ ID NO: 14657 - DNA, 32 bp, Homo sapiens
gaagaaggtcagcagggttcatttaaatggat

SEQ ID NO: 14658 - DNA, 32 bp, Homo sapiens
ccagtgctgctgctgaccttcactgacagctc

SEQ ID NO: 14659 - DNA, 32 bp, Homo sapiens
agcctcctgagtagctgggattacaggcatac

SEQ ID NO: 14660 - DNA, 32 bp, Homo sapiens
ctcactctggcgctctggagtgcagtggtgtg

SEQ ID NO: 14661 - DNA, 32 bp, Homo sapiens
acttcaaagacggatgggttgagctggcagcc

SEQ ID NO: 14662 - DNA, 24 bp, Homo sapiens
tcatgcctataatcttagcacttt

SEQ ID NO: 14663 - DNA, 21 bp, Homo sapiens
caggacagccttcctcctgaa

SEQ ID NO: 14664 - DNA, 32 bp, Homo sapiens
agcctcctgagtagctgggatcacaggcacac

SEQ ID NO: 14665 - DNA, 32 bp, Homo sapiens
aactttgagccttttgtagtcctgatgaataa

SEQ ID NO: 14666 - DNA, 22 bp, Homo sapiens
tctgccaggtctcaaaaattca

SEQ ID NO: 14667 - DNA, 32 bp, Homo sapiens
ttaaacattgttttatcaagtcactgttaagt

SEQ ID NO: 14668 - DNA, 32 bp, Homo sapiens
tcagtcgatttcagttctgataatgttaagaa

SEQ ID NO: 14669 - DNA, 32 bp, Homo sapiens
acctccagctcccaggttgaagcaattctcct

SEQ ID NO: 14670 - DNA, 32 bp, Homo sapiens
acctccacctcccgggttcaagtgattctctg

SEQ ID NO: 14671 - DNA, 32 bp, Homo sapiens
actctgtcacctaggctggagttgcagtggtt

SEQ ID NO: 14672 - DNA, 32 bp, Homo sapiens
actctgtcacccaggctggagtgcaatggcaa

SEQ ID NO: 14673 - DNA, 32 bp, Homo sapiens
gaaggagggaggcaggcatagcatctgaaccc

SEQ ID NO: 14674 - DNA, 32 bp, Homo sapiens
ctgggctcaagcaatcctccctcctcagcctc

SEQ ID NO: 14675 - DNA, 32 bp, Homo sapiens
tggctcatgcctgtatcccagcactttgggag

SEQ ID NO: 14676 - DNA, 32 bp, Homo sapiens
tgagtaagtctacactcttaagtcggtatgaa

SEQ ID NO: 14677 - DNA, 32 bp, Homo sapiens
ggttctgcaatatctctgaggtgcaaagaatg

SEQ ID NO: 14678 - DNA, 24 bp, Homo sapiens
tcaggcctgtaatcccagcatttt

SEQ ID NO: 14679 - DNA, 32 bp, Homo sapiens
ccagtcgggggaggagaaagacgcgattaaca

SEQ ID NO: 14680 - DNA, 23 bp, Homo sapiens
tggtgcgaccttggctcactgca

SEQ ID NO: 14681 - DNA, 32 bp, Homo sapiens
ctctaggtgatctgtgaaaatggttcgctatt

SEQ ID NO: 14682 - DNA, 32 bp, Homo sapiens
cagagtccacaggaaagaagtcactgttgcaa

SEQ ID NO: 14683 - DNA, 32 bp, Homo sapiens
cccaatcctagtagctgggagtatcaggtgag

SEQ ID NO: 14684 - DNA, 32 bp, Homo sapiens
ttcatctgctgtatcctctcccatggagacaa

SEQ ID NO: 14685 - DNA, 32 bp, Homo sapiens
acttccacctcccaggttcaagtgattctcct

SEQ ID NO: 14686 - DNA, 32 bp, Homo sapiens
ctgggctcaagagattgtcccacctcagccta

SEQ ID NO: 14687 - DNA, 32 bp, Homo sapiens
gtcccctgcctgcactggcactttgtccagtc

SEQ ID NO: 14688 - DNA, 32 bp, Homo sapiens
taaagttctagactgggtgaattctttcatga

SEQ ID NO: 14689 - DNA, 32 bp, Homo sapiens
gccactcgcttccctgccatctggcccttccc

SEQ ID NO: 14690 - DNA, 32 bp, Homo sapiens
aaaaataactgcactgactttatatcttttga

SEQ ID NO: 14691 - DNA, 32 bp, Homo sapiens
gacctcccaggtgatcctcccacctcagcttc

SEQ ID NO: 14692 - DNA, 32 bp, Homo sapiens
cctcctggaatcttgaggcactgtgaaattta

SEQ ID NO: 14693 - DNA, 32 bp, Homo sapiens
gcgtggtggagttttcctgtgttttcggcccc

SEQ ID NO: 14694 - DNA, 32 bp, Homo sapiens
gccgggctgctgctgctgctgctccaggtgct

SEQ ID NO: 14695 - DNA, 32 bp, Homo sapiens
aggtttagaagagaaaagagcaacagattttc

SEQ ID NO: 14696 - DNA, 32 bp, Homo sapiens
agccatcatctctcacggtaccacaggcctgg

SEQ ID NO: 14697 - DNA, 32 bp, Homo sapiens
cacagatcggtgtttgaaaatttgccatttca

SEQ ID NO: 14698 - DNA, 32 bp, Homo sapiens
cactgcaacaacaggagtgcaaacttctctac

SEQ ID NO: 14699 - DNA, 32 bp, Homo sapiens
gaagctgggaggcggaggttgcagtgagccaa

SEQ ID NO: 14700 - DNA, 32 bp, Homo sapiens
tgggaggcatgggaaacagtgcagtgactcac

SEQ ID NO: 14701 - DNA, 32 bp, Homo sapiens
gacaccatgaaaggctgctcttaactttgtct

SEQ ID NO: 14702 - DNA, 32 bp, Homo sapiens
tctaaagagaattggttatggggaaaataaca

SEQ ID NO: 14703 - DNA, 32 bp, Homo sapiens
aaatggaggacagaggtgacaaacttcagttt

SEQ ID NO: 14704 - DNA, 32 bp, Homo sapiens
gcagttgtgctgctgcatataacactaccaag

SEQ ID NO: 14705 - DNA, 32 bp, Homo sapiens
tccgtcccttggggaccacaggcatcagcagt

SEQ ID NO: 14706 - DNA, 29 bp, Homo sapiens
cacttcagagcctctgaggggccaccact

SEQ ID NO: 14707 - DNA, 32 bp, Homo sapiens
gaattttgctctattgtaaacatggttcaaaa

SEQ ID NO: 14708 - DNA, 32 bp, Homo sapiens
ctgggctcatgctgggattgtgcagtgctcct

SEQ ID NO: 14709 - DNA, 32 bp, Homo sapiens
ttgagacagagttttgctcttgttgcccaggt

SEQ ID NO: 14710 - DNA, 32 bp, Homo sapiens
acctccgcctcctgggttcaagcgattcaccc

SEQ ID NO: 14711 - DNA, 32 bp, Homo sapiens
tggtgtgggaggcagaggtgctgacgttctgg

SEQ ID NO: 14712 - DNA, 32 bp, Homo sapiens
tggggagggaggcagcgcggtggttatcaacc

SEQ ID NO: 14713 - DNA, 32 bp, Homo sapiens
agatttcaacatcagatggttgaagctggaag

SEQ ID NO: 14714 - DNA, 32 bp, Homo sapiens
gtggtggtggtctcctggcagagcggtgggac

SEQ ID NO: 14715 - DNA, 32 bp, Homo sapiens
tgagcaatgaggaggagtggaaaacaaaaccc

SEQ ID NO: 14716 - DNA, 32 bp, Homo sapiens
agagattccagtgagttgagatcatgcccctg

SEQ ID NO: 14717 - DNA, 32 bp, Homo sapiens
ccgggggctggaggagaagacaaggagttctt

SEQ ID NO: 14718 - DNA, 32 bp, Homo sapiens
tgtattgcatgggctgcattatctacagcatt

SEQ ID NO: 14719 - DNA, 23 bp, Homo sapiens
tggcgctgtctcagctcactgca

SEQ ID NO: 14720 - DNA, 32 bp, Homo sapiens
caatggtgtccaggctggagtgcagtggcgtg

SEQ ID NO: 14721 - DNA, 32 bp, Homo sapiens
ttctgttgtccaggatggagtgcagtggttga

SEQ ID NO: 14722 - DNA, 32 bp, Homo sapiens
ctctgttgcccaggctggagtgcagtggcgct

SEQ ID NO: 14723 - DNA, 32 bp, Homo sapiens
cactcgttgcccaggctggagtgtagaggcga

SEQ ID NO: 14724 - DNA, 32 bp, Homo sapiens
tctttccaaagaagcttcctggacactgttat

SEQ ID NO: 14725 - DNA, 32 bp, Homo sapiens
tacctcttacttcaaattcttctgcctccctc

SEQ ID NO: 14726 - DNA, 32 bp, Homo sapiens
cggggaggggcggatggaggggcctgggttgc

SEQ ID NO: 14727 - DNA, 32 bp, Homo sapiens
ggaggagggagccaggcttcgcttcaaggcgg

SEQ ID NO: 14728 - DNA, 32 bp, Homo sapiens
cattttgatacttgtctatccttcatagtgcc

SEQ ID NO: 14729 - DNA, 32 bp, Homo sapiens
tttggtgtgctgcttcccatgcactactttga

SEQ ID NO: 14730 - DNA, 32 bp, Homo sapiens
ggagccttgcctcagagaccaactggtggctg

SEQ ID NO: 14731 - DNA, 32 bp, Homo sapiens
ctctgtcacccaggctggaatgcagtggtgtg

SEQ ID NO: 14732 - DNA, 32 bp, Homo sapiens
ttctgatgcccaggttggggtgcagtggcaca

SEQ ID NO: 14733 - DNA, 32 bp, Homo sapiens
ctacgtgacccaggctggagtgtagtagctat

SEQ ID NO: 14734 - DNA, 32 bp, Homo sapiens
tgctcctttgagagattcctggaccacaatgg

SEQ ID NO: 14735 - DNA, 32 bp, Homo sapiens
gccttgaactcctgggctcaagcaatcctcct

SEQ ID NO: 14736 - DNA, 28 bp, Homo sapiens
actctctccagtgctgccagcgtcgcac

SEQ ID NO: 14737 - DNA, 32 bp, Homo sapiens
agcctcctgagtagctgggatcacaggtgtgt

SEQ ID NO: 14738 - DNA, 32 bp, Homo sapiens
aaatcaaatgttccttcagtacaggtaacttc

SEQ ID NO: 14739 - DNA, 32 bp, Homo sapiens
ctgttcaaagagacatttgttcaatctctgtg

SEQ ID NO: 14740 - DNA, 32 bp, Homo sapiens
agcctcccgagtagctgggattacaggtgcgc

SEQ ID NO: 14741 - DNA, 32 bp, Homo sapiens
agcctcctgagtagctggaattataggcacat

SEQ ID NO: 14742 - DNA, 32 bp, Homo sapiens
agcctcctgagtagctgggattacaggtgcgt

SEQ ID NO: 14743 - DNA, 32 bp, Homo sapiens
ctggcctcaagtgatccacccacctcagccgc

SEQ ID NO: 14744 - DNA, 32 bp, Homo sapiens
gcttcaaggcctggggagcctgtccttccatg

SEQ ID NO: 14745 - DNA, 19 bp, Homo sapiens
gcccaggctggagtgcaat

SEQ ID NO: 14746 - DNA, 32 bp, Homo sapiens
cactgtcacccaggctgaactgcagtggtgtg

SEQ ID NO: 14747 - DNA, 32 bp, Homo sapiens
acatttctgtgtcatttctaccacagatgcgc

SEQ ID NO: 14748 - DNA, 32 bp, Homo sapiens
gctctgttgtccaggctggagtgcagtggcac

SEQ ID NO: 14749 - DNA, 28 bp, Homo sapiens
ttatgctgagttgctgcctttccccgtc

SEQ ID NO: 14750 - DNA, 32 bp, Homo sapiens
ccgcgggggttagaggtcaccatgctgagggt

SEQ ID NO: 14751 - DNA, 32 bp, Homo sapiens
ttttcctcctctaagaggagatgatgtctgct

SEQ ID NO: 14752 - DNA, 32 bp, Homo sapiens
agcccaggagatgcaggcttgcagtgagccat

SEQ ID NO: 14753 - DNA, 32 bp, Homo sapiens
aggaagtcaaagcaaggaaactatgtaacatg

SEQ ID NO: 14754 - DNA, 32 bp, Homo sapiens
tggggtaattttcttcaaagggagtttgttat

SEQ ID NO: 14755 - DNA, 32 bp, Homo sapiens
gatgtggaaggaggggaagcactgtgacctcc

SEQ ID NO: 14756 - DNA, 32 bp, Homo sapiens
aattgacagctttctaactcacaggcatagag

SEQ ID NO: 14757 - DNA, 32 bp, Homo sapiens
atttgcccaccagcttctcctctggagcctga

SEQ ID NO: 14758 - DNA, 32 bp, Homo sapiens
gatccatccttttgcttcatctggagtccctc

SEQ ID NO: 14759 - DNA, 32 bp, Homo sapiens
ccctgtcacccaggctggagtgcaatggtgcg

SEQ ID NO: 14760 - DNA, 32 bp, Homo sapiens
ttgatcattttgaggctgggtgcagtggctca

SEQ ID NO: 14761 - DNA, 26 bp, Homo sapiens
ctgtgttgcccaggctggagtgcagt

SEQ ID NO: 14762 - DNA, 32 bp, Homo sapiens
accccgtcgcacaggctggagtgcagtggcaa

SEQ ID NO: 14763 - DNA, 32 bp, Homo sapiens
gctcccagcagagtgaggacttcattctctag

SEQ ID NO: 14764 - DNA, 28 bp, Homo sapiens
aggcccccaagtgtggtctttttctttc

SEQ ID NO: 14765 - DNA, 32 bp, Homo sapiens
aatacaaactgcactatgatttgctttaacta

SEQ ID NO: 14766 - DNA, 24 bp, Homo sapiens
ctgtcattcaggctggagtgcagt

SEQ ID NO: 14767 - DNA, 32 bp, Homo sapiens
gcactgttgcccaggctggactgcagtggcgt

SEQ ID NO: 14768 - DNA, 32 bp, Homo sapiens
cctctttttgacagtaaacttctgcctatggc

SEQ ID NO: 14769 - DNA, 32 bp, Homo sapiens
cacaatatcaccaggcttcttctgcctccctt

SEQ ID NO: 14770 - DNA, 18 bp, Homo sapiens
tctgcagcctgccagtgc

SEQ ID NO: 14771 - DNA, 32 bp, Homo sapiens
accttattcccaggctggagtgcaatgtcgtg

SEQ ID NO: 14772 - DNA, 32 bp, Homo sapiens
gccctggccagacatgtccacagggttctcct

SEQ ID NO: 14773 - DNA, 32 bp, Homo sapiens
tataaaagagcctattcaatagctcagaggtt

SEQ ID NO: 14774 - DNA, 32 bp, Homo sapiens
gcctccacctccccggttcaagtgattctcct

SEQ ID NO: 14775 - DNA, 28 bp, Homo sapiens
gaaccaagtcgagctgcctcagagccgg

SEQ ID NO: 14776 - DNA, 32 bp, Homo sapiens
gagcccaggaggtcgaggctgcagtgagctat

SEQ ID NO: 14777 - DNA, 32 bp, Homo sapiens
ccacatctacatcagtgaaagctatctaccta

SEQ ID NO: 14778 - DNA, 32 bp, Homo sapiens
acgtaaaggcatgacttcctggcaccacaggg

SEQ ID NO: 14779 - DNA, 32 bp, Homo sapiens
gagccggggaggcagaggttgcagtgagccga

SEQ ID NO: 14780 - DNA, 32 bp, Homo sapiens
gaacccgggaggcggaggttgcagtgagctaa

SEQ ID NO: 14781 - DNA, 32 bp, Homo sapiens
gagcctaggaggttgaggctgcagtgagctat

SEQ ID NO: 14782 - DNA, 32 bp, Homo sapiens
gaactcaggaggtggaggttgcagtgagctga

SEQ ID NO: 14783 - DNA, 32 bp, Homo sapiens
gagcccaggaggttgaggctgcagtgagccat

SEQ ID NO: 14784 - DNA, 32 bp, Homo sapiens
gagcctgggaggtcaaggctgcagtgagccat

SEQ ID NO: 14785 - DNA, 32 bp, Homo sapiens
gaacccgggaggcggaggttgtggtgagccga

SEQ ID NO: 14786 - DNA, 32 bp, Homo sapiens
gaacctgggaggcggaggttgcagtgagccaa

SEQ ID NO: 14787 - DNA, 32 bp, Homo sapiens
gaaccagggaagcggaggttgcagtgagccga

SEQ ID NO: 14788 - DNA, 32 bp, Homo sapiens
gaacccagaaggcggaagttgcagtgagctga

SEQ ID NO: 14789 - DNA, 32 bp, Homo sapiens
gaacccaggaggcggaggttgcagtgagctga

SEQ ID NO: 14790 - DNA, 32 bp, Homo sapiens
gagcccaggaggtcaaggctgcagtgagctgt

SEQ ID NO: 14791 - DNA, 17 bp, Homo sapiens
gcccctgcttctccagg

SEQ ID NO: 14792 - DNA, 32 bp, Homo sapiens
ctggactcaagcaatctgcccaccttgcctcc

SEQ ID NO: 14793 - DNA, 32 bp, Homo sapiens
cccaagaagagtcccagccccacgccggctac

SEQ ID NO: 14794 - DNA, 32 bp, Homo sapiens
catggactgttgctgctccctgttccatatgc

SEQ ID NO: 14795 - DNA, 24 bp, Homo sapiens
gtcgcccaggctggaatgcagtag

SEQ ID NO: 14796 - DNA, 32 bp, Homo sapiens
ccatcctctcccacttccatctggcgtcccat

SEQ ID NO: 14797 - DNA, 32 bp, Homo sapiens
gaaccctggaggcggaggttgccgtgagccaa

SEQ ID NO: 14798 - DNA, 32 bp, Homo sapiens
tccctctgtaccatctgctgtggaatgcagga

SEQ ID NO: 14799 - DNA, 17 bp, Homo sapiens
gcccctgcatgcccagg

SEQ ID NO: 14800 - DNA, 32 bp, Homo sapiens
ccgagttcaagcaattctcctgcctcagcctc

SEQ ID NO: 14801 - DNA, 32 bp, Homo sapiens
ctgacctcaggcgatccacccacctcagcgtc

SEQ ID NO: 14802 - DNA, 32 bp, Homo sapiens
gggagccccaaaacctaccactcgcgtgttcc

SEQ ID NO: 14803 - DNA, 32 bp, Homo sapiens
ttggacactgcagctcttttcagtttttgctt

SEQ ID NO: 14804 - DNA, 32 bp, Homo sapiens
tcctgggcacattcttttcttctgcttccctt

SEQ ID NO: 14805 - DNA, 32 bp, Homo sapiens
ctttactggagtttcctcttgtccatttctga

SEQ ID NO: 14806 - DNA, 23 bp, Homo sapiens
tggcaccatttcggctcactgca

SEQ ID NO: 14807 - DNA, 23 bp, Homo sapiens
tggcgccatcttggctcactgta

SEQ ID NO: 14808 - DNA, 22 bp, Homo sapiens
gatgaggaaactaaggcttgga

SEQ ID NO: 14809 - DNA, 32 bp, Homo sapiens
agcctgtgtgttcttcacctgtgcctgctcct

SEQ ID NO: 14810 - DNA, 32 bp, Homo sapiens
taggaatgacactcaggttcactgtggaaaac

SEQ ID NO: 14811 - DNA, 32 bp, Homo sapiens
ccgccctccttgctgtcacaggtgcagcctgt

SEQ ID NO: 14812 - DNA, 32 bp, Homo sapiens
gtgaaggctatctggggcaggcacaaattggt

SEQ ID NO: 14813 - DNA, 24 bp, Homo sapiens
tcacgcctgtaatcccaaagtgct

SEQ ID NO: 14814 - DNA, 32 bp, Homo sapiens
atgattacagttctgaatctgtaacacttaca

SEQ ID NO: 14815 - DNA, 32 bp, Homo sapiens
ctggaagcggtactgtatctctctccaaggcc

SEQ ID NO: 14816 - DNA, 32 bp, Homo sapiens
gattttatgctgctgtttacaaaagcccaatg

SEQ ID NO: 14817 - DNA, 32 bp, Homo sapiens
gaacccggaaggcagaggttgcagtgagccga

SEQ ID NO: 14818 - DNA, 32 bp, Homo sapiens
gaacctgggaggcagaagttgcagtgagctga

SEQ ID NO: 14819 - DNA, 32 bp, Homo sapiens
aggaagctctgaggatggttgcagtgaggaag

SEQ ID NO: 14820 - DNA, 32 bp, Homo sapiens
actctctcgcccaggctggagtgcagtggtgt

SEQ ID NO: 14821 - DNA, 32 bp, Homo sapiens
ctgctgttgcccagctggacagctagagttat

SEQ ID NO: 14822 - DNA, 32 bp, Homo sapiens
actctgttgcccaagctggagaacagtggcac

SEQ ID NO: 14823 - DNA, 32 bp, Homo sapiens
agcctttcgagtagctgggactacaggtgtgt

SEQ ID NO: 14824 - DNA, 32 bp, Homo sapiens
ggcctctgaagggattcctcactgtgggcagc

SEQ ID NO: 14825 - DNA, 32 bp, Homo sapiens
actctgtcgcccaggctggagggcagtggcgt

SEQ ID NO: 14826 - DNA, 32 bp, Homo sapiens
tggttttcaagcagtgctttatctcatgtcct

SEQ ID NO: 14827 - DNA, 32 bp, Homo sapiens
agcctcctgagtagctggattacaggcatgtg

SEQ ID NO: 14828 - DNA, 32 bp, Homo sapiens
ggcctcccaaagtgttgggattacatgcatga

SEQ ID NO: 14829 - DNA, 32 bp, Homo sapiens
catccatgtccctcgtgttggacactagagct

SEQ ID NO: 14830 - DNA, 32 bp, Homo sapiens
caagcctctctctcttcctactgagcacctgt

SEQ ID NO: 14831 - DNA, 32 bp, Homo sapiens
gcagggtctgggtgggtctcccaggagaggaa

SEQ ID NO: 14832 - DNA, 32 bp, Homo sapiens
ctctgttgcccaggctggagtgcagtggtggg

SEQ ID NO: 14833 - DNA, 32 bp, Homo sapiens
ctgtcatgcccagcttggagtgccacatggcc

SEQ ID NO: 14834 - DNA, 21 bp, Homo sapiens
acaggcatgagccaccgtggc

SEQ ID NO: 14835 - DNA, 32 bp, Homo sapiens
ggacatccaggtgcccttcatccaagctccta

SEQ ID NO: 14836 - DNA, 32 bp, Homo sapiens
gaaagctctgcagctaggtcctctcatcagcc

SEQ ID NO: 14837 - DNA, 32 bp, Homo sapiens
ctgagctcaagtgatcctcccacctcagcctc

SEQ ID NO: 14838 - DNA, 32 bp, Homo sapiens
ccttccggtgctcacacgcccacgccgtgcca

SEQ ID NO: 14839 - DNA, 32 bp, Homo sapiens
ctttatcgcccaggctggagtacagtgatgca

SEQ ID NO: 14840 - DNA, 32 bp, Homo sapiens
ccatctcactcacacacacaggcatccataca

SEQ ID NO: 14841 - DNA, 32 bp, Homo sapiens
ccccagcagctttcccagagaggcagaggggc

SEQ ID NO: 14842 - DNA, 32 bp, Homo sapiens
cactgtaacctctgggttcaagcaattcttct

SEQ ID NO: 14843 - DNA, 32 bp, Homo sapiens
cactctgtcaccaggctggagtgcagtggcgc

SEQ ID NO: 14844 - DNA, 32 bp, Homo sapiens
agggggctgccaggctggctgccgatgctccg

SEQ ID NO: 14845 - DNA, 32 bp, Homo sapiens
gatgtcagagctaccagtgtgctgctgggaga

SEQ ID NO: 14846 - DNA, 32 bp, Homo sapiens
cgctctatcgccaggctggagtgtagtggcat

SEQ ID NO: 14847 - DNA, 32 bp, Homo sapiens
cgctctgtcgccaggctggagtgcagtggcgc

SEQ ID NO: 14848 - DNA, 32 bp, Homo sapiens
cgctctgtcgccaggttggagtgcagtggcgt

SEQ ID NO: 14849 - DNA, 32 bp, Homo sapiens
gacctcaggcgatccacccccacctcggcttc

SEQ ID NO: 14850 - DNA, 32 bp, Homo sapiens
ccgggttcaagcaatcctccctgcctcagcct

SEQ ID NO: 14851 - DNA, 32 bp, Homo sapiens
ctggagaaagagacacacggggtgactgtggc

SEQ ID NO: 14852 - DNA, 22 bp, Homo sapiens
cagaagagcctctgtccagccc

SEQ ID NO: 14853 - DNA, 32 bp, Homo sapiens
tggggtagcgacagacaatcccagaaacacgc

SEQ ID NO: 14854 - DNA, 32 bp, Homo sapiens
ggggaatagaagggagaaagagaatatcatgg

SEQ ID NO: 14855 - DNA, 32 bp, Homo sapiens
ctctgttacccaggctggagtgcagtggtgtg

SEQ ID NO: 14856 - DNA, 32 bp, Homo sapiens
ggggttggtagcagagaaagagaagagaacag

SEQ ID NO: 14857 - DNA, 32 bp, Homo sapiens
cacctcacctgtcgcacccactgtgaaagttg

SEQ ID NO: 14858 - DNA, 32 bp, Homo sapiens
ctctgtcacccaggctggagtgcggtggtgca

SEQ ID NO: 14859 - DNA, 32 bp, Homo sapiens
ctctgtcgcccaggctggagtgcagtggtgca

SEQ ID NO: 14860 - DNA, 32 bp, Homo sapiens
ctccgtgacccaggctggaatgcaatggctca

SEQ ID NO: 14861 - DNA, 32 bp, Homo sapiens
ctctgtcacccaggctggagtgcagtggtgcg

SEQ ID NO: 14862 - DNA, 32 bp, Homo sapiens
ctctgtcacccaggttggagtgcagtggtgtg

SEQ ID NO: 14863 - DNA, 32 bp, Homo sapiens
ctctgttgcccaggctggagtgcagtggtgta

SEQ ID NO: 14864 - DNA, 32 bp, Homo sapiens
aagtaaagcccaagtgttctttagctttttat

SEQ ID NO: 14865 - DNA, 32 bp, Homo sapiens
tccactcggcctgggaggttctggattttggc

SEQ ID NO: 14866 - DNA, 32 bp, Homo sapiens
gctgagcatcttctcccaggagtaccagaaac

SEQ ID NO: 14867 - DNA, 32 bp, Homo sapiens
attacgtcacagcttcccatctggttgctttc

SEQ ID NO: 14868 - DNA, 32 bp, Homo sapiens
ggctcacacctgcaatcccagcactttgggag

SEQ ID NO: 14869 - DNA, 32 bp, Homo sapiens
gggccgtgcccagggcggtggctgtgagtcta

SEQ ID NO: 14870 - DNA, 32 bp, Homo sapiens
gggctgtgcccaggccacagagcagctgcagg

SEQ ID NO: 14871 - DNA, 23 bp, Homo sapiens
tggaacgatcttggctcactgca

SEQ ID NO: 14872 - DNA, 32 bp, Homo sapiens
cctgctctgcccaggaggtggcgtccagcagt

SEQ ID NO: 14873 - DNA, 32 bp, Homo sapiens
tcctgctgctgcattttaaagcacttttatag

SEQ ID NO: 14874 - DNA, 32 bp, Homo sapiens
gagtctgaaaccattccatttcattttggtga

SEQ ID NO: 14875 - DNA, 32 bp, Homo sapiens
attctgtcacccaggctggagtgcagtggcgt

SEQ ID NO: 14876 - DNA, 23 bp, Homo sapiens
cacgcctgtaatcccagctactt

SEQ ID NO: 14877 - DNA, 32 bp, Homo sapiens
taaaactgcatgatgaatagcaccttaatttc

SEQ ID NO: 14878 - DNA, 32 bp, Homo sapiens
ggctcgtgcctgtactcccagcactttgggag

SEQ ID NO: 14879 - DNA, 32 bp, Homo sapiens
gcaccttgtccaaggagacaccactttcaccc

SEQ ID NO: 14880 - DNA, 32 bp, Homo sapiens
gggcaccatcttctcattcatctccaaggacg

SEQ ID NO: 14881 - DNA, 20 bp, Homo sapiens
gcctgtaatcccaggacttt

SEQ ID NO: 14882 - DNA, 32 bp, Homo sapiens
ctctgttgcccaggctagagtgcagtggtgca

SEQ ID NO: 14883 - DNA, 21 bp, Homo sapiens
cagggaagctcatcaaagccc

SEQ ID NO: 14884 - DNA, 26 bp, Homo sapiens
tacaggcatcagccaccacacccagc

SEQ ID NO: 14885 - DNA, 32 bp, Homo sapiens
tcctctgttgccaggctggaatgccgtggcgc

SEQ ID NO: 14886 - DNA, 32 bp, Homo sapiens
gaacctgggaggtagaagttgcagtgagccaa

SEQ ID NO: 14887 - DNA, 32 bp, Homo sapiens
caaggcgccattggcttcctgggactctgagt

SEQ ID NO: 14888 - DNA, 32 bp, Homo sapiens
gtattgagtcttcctttcaaggaccataaggt

SEQ ID NO: 14889 - DNA, 32 bp, Homo sapiens
attttctctgcagcttattcttgccatgctta

SEQ ID NO: 14890 - DNA, 32 bp, Homo sapiens
cctatggtttttctgtgtcaatgtgatttatg

SEQ ID NO: 14891 - DNA, 32 bp, Homo sapiens
agaagctgaacaggagaaagacaaacagaaag

SEQ ID NO: 14892 - DNA, 23 bp, Homo sapiens
tggcacgatctgggctcattgca

SEQ ID NO: 14893 - DNA, 32 bp, Homo sapiens
ggaccagccctctcggtttgggaataaggcat

SEQ ID NO: 14894 - DNA, 32 bp, Homo sapiens
ttttgtcgcccaggctggagtgcagtggcatg

SEQ ID NO: 14895 - DNA, 32 bp, Homo sapiens
tctctgctattcatgaatcttgctattgcaca

SEQ ID NO: 14896 - DNA, 32 bp, Homo sapiens
acatattttccctgtttgctttgctactgtat

SEQ ID NO: 14897 - DNA, 28 bp, Homo sapiens
tccttcttatcgcctgcctcatcgctca

SEQ ID NO: 14898 - DNA, 28 bp, Homo sapiens
ggctctctctctgctgcctcttcatacg

SEQ ID NO: 14899 - DNA, 32 bp, Homo sapiens
actctgtcaaccaggctggagtgcactggcgc

SEQ ID NO: 14900 - DNA, 32 bp, Homo sapiens
gaacccgggaggcagaggtggctgtgagccga

SEQ ID NO: 14901 - DNA, 32 bp, Homo sapiens
cccacctggaccacctgacccctcgggattcc

SEQ ID NO: 14902 - DNA, 32 bp, Homo sapiens
cgaaactgacttgctcacctggaacacctgat

SEQ ID NO: 14903 - DNA, 32 bp, Homo sapiens
gctctgtcacccaggctggagtgcgatggcgc

SEQ ID NO: 14904 - DNA, 32 bp, Homo sapiens
ggtggcccaagtgctcttggtggcccagcttg

SEQ ID NO: 14905 - DNA, 32 bp, Homo sapiens
gaacccgggaggcagaggttgtgagctgagat

SEQ ID NO: 14906 - DNA, 32 bp, Homo sapiens
aaaggcgtgacggagagctggggctctgagag

SEQ ID NO: 14907 - DNA, 32 bp, Homo sapiens
actctgtcacccaggctagagtgcagtggcgc

SEQ ID NO: 14908 - DNA, 32 bp, Homo sapiens
actctgtcacccaggctggagtgcaatggcgc

SEQ ID NO: 14909 - DNA, 23 bp, Homo sapiens
tggcgcgatttcggctcactgca

SEQ ID NO: 14910 - DNA, 32 bp, Homo sapiens
caattccatcttctcccatggaacctcaaaga

SEQ ID NO: 14911 - DNA, 32 bp, Homo sapiens
gaaaaatcacacaggctgggtgcagtggctca

SEQ ID NO: 14912 - DNA, 32 bp, Homo sapiens
tgagctgtgcttcttcaagtagctcagttctt

SEQ ID NO: 14913 - DNA, 32 bp, Homo sapiens
gaacccaggaggtagaggctgcagtgagctgg

SEQ ID NO: 14914 - DNA, 28 bp, Homo sapiens
ctttttccaagtgcttgttttatttatt

SEQ ID NO: 14915 - DNA, 32 bp, Homo sapiens
cagattcatcattattcctaaagtattgctgt

SEQ ID NO: 14916 - DNA, 24 bp, Homo sapiens
ttgtagcccaggctggagtgcaat

SEQ ID NO: 14917 - DNA, 32 bp, Homo sapiens
tacacactgagtagtatgtatttcatggatga

SEQ ID NO: 14918 - DNA, 32 bp, Homo sapiens
aatcatctgggctcctgtccagctccacatgt

SEQ ID NO: 14919 - DNA, 32 bp, Homo sapiens
ttagtctaactctgcatagacagggtctagat

SEQ ID NO: 14920 - DNA, 32 bp, Homo sapiens
aactcccagcggagagcaaggttttcttctgt

SEQ ID NO: 14921 - DNA, 32 bp, Homo sapiens
gtgtgtacaaactgatatctttgcctaccagc

SEQ ID NO: 14922 - DNA, 32 bp, Homo sapiens
agctgtctgttcctgctcacactgccagaatc

SEQ ID NO: 14923 - DNA, 32 bp, Homo sapiens
ttctctgctgtggttgctgcagctccaggaag

SEQ ID NO: 14924 - DNA, 32 bp, Homo sapiens
taggtcgggaggcacctctagcatgagacagt

SEQ ID NO: 14925 - DNA, 32 bp, Homo sapiens
gtctggaactcctgggctcaagcaatcctccc

SEQ ID NO: 14926 - DNA, 32 bp, Homo sapiens
agagtgtcacccaacctgcaggcagtgtcatg

SEQ ID NO: 14927 - DNA, 32 bp, Homo sapiens
ctgggcttaagtgatcctcccacctcagtctc

SEQ ID NO: 14928 - DNA, 32 bp, Homo sapiens
gctctctcacccaggctggagtgtaagtgaca

SEQ ID NO: 14929 - DNA, 32 bp, Homo sapiens
ttgagatggagttttgctcttgttgctgaggc

SEQ ID NO: 14930 - DNA, 24 bp, Homo sapiens
acaggcgtcagccaccgcgcctgg

SEQ ID NO: 14931 - DNA, 32 bp, Homo sapiens
acacatttgcctgcttctctcttgcctaattc

SEQ ID NO: 14932 - DNA, 28 bp, Homo sapiens
tcactacttaagttagcctcatcatttt

SEQ ID NO: 14933 - DNA, 32 bp, Homo sapiens
ggggcctcacccagaaggaacccggtcccagg

SEQ ID NO: 14934 - DNA, 32 bp, Homo sapiens
acctccgactcctgggttcaagcaattcttct

SEQ ID NO: 14935 - DNA, 28 bp, Homo sapiens
ggaggccccagcacagcctcatctccat

SEQ ID NO: 14936 - DNA, 32 bp, Homo sapiens
agcctcccgagtagctgggattatagacacgt

SEQ ID NO: 14937 - DNA, 32 bp, Homo sapiens
tctttgctttaagtgtaactggcagttttcca

SEQ ID NO: 14938 - DNA, 32 bp, Homo sapiens
gctctgttgcccaggctggagtgcggtggact

SEQ ID NO: 14939 - DNA, 32 bp, Homo sapiens
aacaaaactatacttgaacaaaagggtcagag

SEQ ID NO: 14940 - DNA, 32 bp, Homo sapiens
gaccctgcaggaggagcttggactggccccag

SEQ ID NO: 14941 - DNA, 32 bp, Homo sapiens
agctgatgttctttgggtattacttgagtagt

SEQ ID NO: 14942 - DNA, 32 bp, Homo sapiens
aagaataacagaataggaggaaaacaagggga

SEQ ID NO: 14943 - DNA, 24 bp, Homo sapiens
ctgaccaacatggagaaacccatc

SEQ ID NO: 14944 - DNA, 32 bp, Homo sapiens
aaaggttcaatcaataaaaatattttattcaa

SEQ ID NO: 14945 - DNA, 32 bp, Homo sapiens
tgctctgtctccaggctggagtacagtggtgc

SEQ ID NO: 14946 - DNA, 32 bp, Homo sapiens
gaacccgggaggcgagcttgcagtgagccgag

SEQ ID NO: 14947 - DNA, 32 bp, Homo sapiens
acctccacttccctggttcaagcaattcccct

SEQ ID NO: 14948 - DNA, 24 bp, Homo sapiens
tcatgcctgaaatcctagcacttt

SEQ ID NO: 14949 - DNA, 32 bp, Homo sapiens
cggcctttgctgtggctggagctggacagtgc

SEQ ID NO: 14950 - DNA, 32 bp, Homo sapiens
gctgtgtcgccaaggctggagtgcagtggtgc

SEQ ID NO: 14951 - DNA, 32 bp, Homo sapiens
atggcagtcgaaggagcttcgtctggcagcag

SEQ ID NO: 14952 - DNA, 32 bp, Homo sapiens
tagtctcatcttcttaactccctcaggcatca

SEQ ID NO: 14953 - DNA, 32 bp, Homo sapiens
gacatcaaagcatcagctctctggacctggga

SEQ ID NO: 14954 - DNA, 32 bp, Homo sapiens
tcttgtctcccaggctggagtgcagtgacaca

SEQ ID NO: 14955 - DNA, 32 bp, Homo sapiens
tggttccaagtctttgctattgtgaatagtgc

SEQ ID NO: 14956 - DNA, 23 bp, Homo sapiens
caggagggtctctcctccagccc

SEQ ID NO: 14957 - DNA, 32 bp, Homo sapiens
cctctgtcacccaggctagagggtggtgatat

SEQ ID NO: 14958 - DNA, 29 bp, Homo sapiens
gaggatgaacaacaagttcgacgctttga

SEQ ID NO: 14959 - DNA, 32 bp, Homo sapiens
tgggggccctgtgcccttgccggcggcaggtt

SEQ ID NO: 14960 - DNA, 28 bp, Homo sapiens
acgcccccatctgctgccttttctattg

SEQ ID NO: 14961 - DNA, 32 bp, Homo sapiens
aggcttctgagtagctgggattataggtgcgc

SEQ ID NO: 14962 - DNA, 32 bp, Homo sapiens
agtctcctgagtagctgggattacaggcaccc

SEQ ID NO: 14963 - DNA, 32 bp, Homo sapiens
ggcctctggagtagctgggactacaggtgccc

SEQ ID NO: 14964 - DNA, 32 bp, Homo sapiens
gcctaggtgaagacctggaaaaggaagggtta

SEQ ID NO: 14965 - DNA, 32 bp, Homo sapiens
ctacatttagttctccccactctgatcccctg

SEQ ID NO: 14966 - DNA, 23 bp, Homo sapiens
tcatgcctgtaatcccaactctt

SEQ ID NO: 14967 - DNA, 32 bp, Homo sapiens
tccaaagtcctctaaactgacagggtctcatt

SEQ ID NO: 14968 - DNA, 18 bp, Homo sapiens
gaccacaccccaatgcct

SEQ ID NO: 14969 - DNA, 32 bp, Homo sapiens
ctccagtgtcctccatgacaccagctttctcc

SEQ ID NO: 14970 - DNA, 21 bp, Homo sapiens
gcctgggcatctgacctcccc

SEQ ID NO: 14971 - DNA, 32 bp, Homo sapiens
aaaatgacttttaggctgggtgcagtggctca

SEQ ID NO: 14972 - DNA, 25 bp, Homo sapiens
ctggtcaacatggcaaaagcccatc

SEQ ID NO: 14973 - DNA, 32 bp, Homo sapiens
ctctattgcccaggctggagtgcagtggtaca

SEQ ID NO: 14974 - DNA, 32 bp, Homo sapiens
caatgttgcccaggctggagtgcagtggcgtg

SEQ ID NO: 14975 - DNA, 32 bp, Homo sapiens
cttagcttttctgaattctgcagtattttcta

SEQ ID NO: 14976 - DNA, 32 bp, Homo sapiens
acctccgcctcctgggttcaggagattctcct

SEQ ID NO: 14977 - DNA, 32 bp, Homo sapiens
cctgtgttgctcaggctggagtgcagtggtgt

SEQ ID NO: 14978 - DNA, 32 bp, Homo sapiens
attctgttgcccaggctggagtgcaatggcat

SEQ ID NO: 14979 - DNA, 32 bp, Homo sapiens
ccttccagggtttagggagtgcagtgatgtcg

SEQ ID NO: 14980 - DNA, 32 bp, Homo sapiens
ctcatctctcttctccaggactcctgcactga

SEQ ID NO: 14981 - DNA, 31 bp, Homo sapiens
cagcagcagcagccggcgaggagggagcagc

SEQ ID NO: 14982 - DNA, 32 bp, Homo sapiens
aaaagaagagcaagagaaagagaaacaaaaat

SEQ ID NO: 14983 - DNA, 32 bp, Homo sapiens
cagcgcccccagaacatacactgtgaactcaa

SEQ ID NO: 14984 - DNA, 32 bp, Homo sapiens
aggcattctgcagctgggatcagcctcagctt

SEQ ID NO: 14985 - DNA, 32 bp, Homo sapiens
ctatagcatcttctcattcccatgtggaacag

SEQ ID NO: 14986 - DNA, 32 bp, Homo sapiens
ctttgtcacccaggctagagtgcagtggcatg

SEQ ID NO: 14987 - DNA, 32 bp, Homo sapiens
ctgcagaggccgggctggaggagaagatggcg

SEQ ID NO: 14988 - DNA, 32 bp, Homo sapiens
tcaaatcagttcagtgaaaatagtacagattt

SEQ ID NO: 14989 - DNA, 28 bp, Homo sapiens
cgcccgccgagtgctgctgggttgggca

SEQ ID NO: 14990 - DNA, 32 bp, Homo sapiens
ggctcatgcctgtaatcccagcactttgggat

SEQ ID NO: 14991 - DNA, 32 bp, Homo sapiens
ggaggaagcttattaggttcactgttgaatga

SEQ ID NO: 14992 - DNA, 32 bp, Homo sapiens
ataaatcaagctcagtctgggttatggagaag

SEQ ID NO: 14993 - DNA, 25 bp, Homo sapiens
tcctctctgtgctgaacatcctgtg

SEQ ID NO: 14994 - DNA, 19 bp, Homo sapiens
tgtgagggagagacgggga

SEQ ID NO: 14995 - DNA, 32 bp, Homo sapiens
ggctcatgcctgtaagcccagcactttgggag

SEQ ID NO: 14996 - DNA, 32 bp, Homo sapiens
actggcaggaggcaggtgcagggaggcctggg

SEQ ID NO: 14997 - DNA, 32 bp, Homo sapiens
cctatgtcaccgaggctacagtgcagtggttc

SEQ ID NO: 14998 - DNA, 32 bp, Homo sapiens
ggacaggccaggcctgatcccacctcacttcc

SEQ ID NO: 14999 - DNA, 32 bp, Homo sapiens
ccagcctcttccattccctttcttttcatgcc

SEQ ID NO: 15000 - DNA, 32 bp, Homo sapiens
gaacctgggaggcggaggttgcagtgagccgc

SEQ ID NO: 15001 - DNA, 16 bp, Homo sapiens
gccatcactgcccagg

SEQ ID NO: 15002 - DNA, 32 bp, Homo sapiens
gtggagggcagaggagaggggacaagacaggg

SEQ ID NO: 15003 - DNA, 32 bp, Homo sapiens
gggctagaggacagagaaagagaatagaatga

SEQ ID NO: 15004 - DNA, 32 bp, Homo sapiens
aaagaaagagagggagaaagagagggagaaag

SEQ ID NO: 15005 - DNA, 32 bp, Homo sapiens
tggggtgtgctgctgctgctccccagcccacc

SEQ ID NO: 15006 - DNA, 32 bp, Homo sapiens
ctgcgctgctcctggctcacagcgctccgggc

SEQ ID NO: 15007 - DNA, 32 bp, Homo sapiens
ctcccaatggaggggaggttgcaggggagagc

SEQ ID NO: 15008 - DNA, 28 bp, Homo sapiens
agatctccaattgctgcctccattgatg

SEQ ID NO: 15009 - DNA, 32 bp, Homo sapiens
gaacccttgggtagcttgattctgcctaccat

SEQ ID NO: 15010 - DNA, 32 bp, Homo sapiens
ctgctcctctgagcttctcctgctcctctctg

SEQ ID NO: 15011 - DNA, 32 bp, Homo sapiens
agcctcttgaatagctgggattacaggcgccc

SEQ ID NO: 15012 - DNA, 32 bp, Homo sapiens
tatctaaggaaaaaggtgaatatgtttttgta

SEQ ID NO: 15013 - DNA, 32 bp, Homo sapiens
tggtgccccaaaacttcacaaccacctagaca

SEQ ID NO: 15014 - DNA, 32 bp, Homo sapiens
gtaagccaagcagctttgcttctgcctctgtt

SEQ ID NO: 15015 - DNA, 28 bp, Homo sapiens
ccttcttcaagtgctgcctgctcactga

SEQ ID NO: 15016 - DNA, 32 bp, Homo sapiens
gctctgttgcccaggcaggagtacagtggcat

SEQ ID NO: 15017 - DNA, 32 bp, Homo sapiens
gaaactggaaggcagaggttgcagtgagccga

SEQ ID NO: 15018 - DNA, 32 bp, Homo sapiens
acccggtagaggcggaggttgcagtgagccga

SEQ ID NO: 15019 - DNA, 32 bp, Homo sapiens
aagggctgccactgcacttagcactttcaggc

SEQ ID NO: 15020 - DNA, 32 bp, Homo sapiens
aggctgccgcggggcaggggtgcagtgggtgt

SEQ ID NO: 15021 - DNA, 32 bp, Homo sapiens
acaatgtttcttctgcaactggctactcctct

SEQ ID NO: 15022 - DNA, 32 bp, Homo sapiens
ggagtgcgggggagggaaagaaaacaaacagt

SEQ ID NO: 15023 - DNA, 32 bp, Homo sapiens
tccttggttcgcccggttttctgttttcagta

SEQ ID NO: 15024 - DNA, 32 bp, Homo sapiens
gctcttcttcattatgctcttctgcctggggc

SEQ ID NO: 15025 - DNA, 32 bp, Homo sapiens
acctccacctcctgggttcacgcaattctcct

SEQ ID NO: 15026 - DNA, 32 bp, Homo sapiens
ggactcagcagtggcctggacaacagcctcag

SEQ ID NO: 15027 - DNA, 32 bp, Homo sapiens
gaacccgggaggtggaggttgccgtgagccaa

SEQ ID NO: 15028 - DNA, 32 bp, Homo sapiens
tccctccagtggcacctcctggaaacagtcca

SEQ ID NO: 15029 - DNA, 32 bp, Homo sapiens
atgaggttggacaaggcttcacagaatttctg

SEQ ID NO: 15030 - DNA, 32 bp, Homo sapiens
actctgtcgcccagactggagtgcagtagcgc

SEQ ID NO: 15031 - DNA, 32 bp, Homo sapiens
actctgttgctcaggctggagtgcagtggcac

SEQ ID NO: 15032 - DNA, 20 bp, Homo sapiens
gcctataatcccagcacttt

SEQ ID NO: 15033 - DNA, 32 bp, Homo sapiens
acttctagatagaatgaatgaaaacaacacaa

SEQ ID NO: 15034 - DNA, 32 bp, Homo sapiens
tcaaatgcctccatctccataccatttcagtt

SEQ ID NO: 15035 - DNA, 21 bp, Homo sapiens
ccaggctcactcacagagtca

SEQ ID NO: 15036 - DNA, 32 bp, Homo sapiens
cacctgggaattcgctggaaatgcaggctcaa

SEQ ID NO: 15037 - DNA, 32 bp, Homo sapiens
attgctttcttcctccccatttggacccttct

SEQ ID NO: 15038 - DNA, 32 bp, Homo sapiens
ctctgttgcccaggctggagtacagtggcacg

SEQ ID NO: 15039 - DNA, 32 bp, Homo sapiens
ctctgtcgcccaggctagagtgcaatggcgtg

SEQ ID NO: 15040 - DNA, 32 bp, Homo sapiens
tcattggtctgtctgggacgtgcagtgttcat

SEQ ID NO: 15041 - DNA, 32 bp, Homo sapiens
gccctggcccagctctggagtgcatgtgtgtg

SEQ ID NO: 15042 - DNA, 32 bp, Homo sapiens
ctctgtcgcccaggttggagtgcagtggcgcg

SEQ ID NO: 15043 - DNA, 32 bp, Homo sapiens
ctctgtttcccaggctggagtgcagtggcgct

SEQ ID NO: 15044 - DNA, 32 bp, Homo sapiens
ctctgttgcccaggctggagtgcagtggcgcg

SEQ ID NO: 15045 - DNA, 32 bp, Homo sapiens
ctctgttgcccagtctggagttcagtggcgcg

SEQ ID NO: 15046 - DNA, 32 bp, Homo sapiens
ctctgttgcccagactggagtgcagtggcacg

SEQ ID NO: 15047 - DNA, 32 bp, Homo sapiens
ctctgtcacccaggctggagtacagtggcata

SEQ ID NO: 15048 - DNA, 32 bp, Homo sapiens
tcttgttgcccaggctagagtgcaatggcaca

SEQ ID NO: 15049 - DNA, 32 bp, Homo sapiens
ctctgtcgcccaggctggagtgcagtggcgtg

SEQ ID NO: 15050 - DNA, 32 bp, Homo sapiens
accctgttgcccaggctggaatacagtggcac

SEQ ID NO: 15051 - DNA, 29 bp, Homo sapiens
tgcgtataacatcagtgaggaagactgca

SEQ ID NO: 15052 - DNA, 32 bp, Homo sapiens
ctttgacacccaggctggagtgcagtagcaca

SEQ ID NO: 15053 - DNA, 25 bp, Homo sapiens
aaccctactgggatcaaactggaat

SEQ ID NO: 15054 - DNA, 32 bp, Homo sapiens
gttcacgaagtgaggccgctgttgaaattcgt

SEQ ID NO: 15055 - DNA, 32 bp, Homo sapiens
gaacccaggaggcggaggttgcagtgagctca

SEQ ID NO: 15056 - DNA, 32 bp, Homo sapiens
gaacctgggaggcggaggttgccgtgagccga

SEQ ID NO: 15057 - DNA, 32 bp, Homo sapiens
gaacccgggaggtggaggttgccgtgagttga

SEQ ID NO: 15058 - DNA, 32 bp, Homo sapiens
aaaaaggaagggcctctcctgtggaaagggaa

SEQ ID NO: 15059 - DNA, 32 bp, Homo sapiens
ctaaaatcatccagactgttggtggtggtgct

SEQ ID NO: 15060 - DNA, 32 bp, Homo sapiens
gaacctcggaggcggaggttgcagtgagccaa

SEQ ID NO: 15061 - DNA, 32 bp, Homo sapiens
cacagctctgcagcctgtttcctacaaccaga

SEQ ID NO: 15062 - DNA, 32 bp, Homo sapiens
acatctcatcttctgtcctcagatggatttac

SEQ ID NO: 15063 - DNA, 32 bp, Homo sapiens
caagggacaagaggagcagaggacaggtgatg

SEQ ID NO: 15064 - DNA, 32 bp, Homo sapiens
aattttgaggggagggaaagaaacaatacctt

SEQ ID NO: 15065 - DNA, 32 bp, Homo sapiens
ggcaggagagagggaaaaagaaaagaaggaac

SEQ ID NO: 15066 - DNA, 32 bp, Homo sapiens
cggccaagagcctggagaaagggagcaagctg

SEQ ID NO: 15067 - DNA, 32 bp, Homo sapiens
accactatctccgttccatctgggcttatatg

SEQ ID NO: 15068 - DNA, 32 bp, Homo sapiens
gatcccccaagtgtcctggaccctggcctaaa

SEQ ID NO: 15069 - DNA, 32 bp, Homo sapiens
actctgtcacccaggttggagtgcagcagggg

SEQ ID NO: 15070 - DNA, 22 bp, Homo sapiens
gagtctagtgcagacccgtgat

SEQ ID NO: 15071 - DNA, 32 bp, Homo sapiens
ggaagtaggcagggagaaaggaacatccggaa

SEQ ID NO: 15072 - DNA, 32 bp, Homo sapiens
ttttgtagacctgccttatgcaccttactgcc

SEQ ID NO: 15073 - DNA, 23 bp, Homo sapiens
tcacacctgtaatctcagcctcc

SEQ ID NO: 15074 - DNA, 25 bp, Homo sapiens
tcatgcctgtaatctcaagcacttt

SEQ ID NO: 15075 - DNA, 19 bp, Homo sapiens
ccgcgcctcccttgcctca

SEQ ID NO: 15076 - DNA, 32 bp, Homo sapiens
attgccttatctctccccatctagccaggaat

SEQ ID NO: 15077 - DNA, 32 bp, Homo sapiens
agcatgccttggagagagcagacactgtgggg

SEQ ID NO: 15078 - DNA, 21 bp, Homo sapiens
catgcctgtaatctcagcact

SEQ ID NO: 15079 - DNA, 32 bp, Homo sapiens
cagttttagtcactgtgaaatatttcacattc

SEQ ID NO: 15080 - DNA, 32 bp, Homo sapiens
taatgatggagttttgctcttacgcccaggct

SEQ ID NO: 15081 - DNA, 32 bp, Homo sapiens
atctttggcagctcttttcttctgctcagacc

SEQ ID NO: 15082 - DNA, 32 bp, Homo sapiens
attgtgaccacaggctggtgtgtaggtggtaa

SEQ ID NO: 15083 - DNA, 32 bp, Homo sapiens
ctctgtcacccaggatggagtgcagtgttgtg

SEQ ID NO: 15084 - DNA, 32 bp, Homo sapiens
ctctgtcacccaggctggagtgcaatggtgag

SEQ ID NO: 15085 - DNA, 32 bp, Homo sapiens
gacctcaggaggcggaggttgcagtgagccga

SEQ ID NO: 15086 - DNA, 32 bp, Homo sapiens
gtaatcacctactggattcaagcaattctcct

SEQ ID NO: 15087 - DNA, 32 bp, Homo sapiens
caagcgggtcataaggcttcagcttctgggtg

SEQ ID NO: 15088 - DNA, 32 bp, Homo sapiens
tggcttcagcccaggcgtggtgtcagtttcct

SEQ ID NO: 15089 - DNA, 32 bp, Homo sapiens
ctactcgggaggctgaggcaggagaattgctt

SEQ ID NO: 15090 - DNA, 23 bp, Homo sapiens
tcacgcctgtaatcctatccttt

SEQ ID NO: 15091 - DNA, 32 bp, Homo sapiens
ctgacctcaggtgatccgtccacctcagcctc

SEQ ID NO: 15092 - DNA, 32 bp, Homo sapiens
tgtagggtgacggaaagtaggaagtgaatttg

SEQ ID NO: 15093 - DNA, 32 bp, Homo sapiens
tgtcagtcccaccttgaagacagagttccagg

SEQ ID NO: 15094 - DNA, 32 bp, Homo sapiens
gggactctgcacctacctcacagggttgttgt

SEQ ID NO: 15095 - DNA, 24 bp, Homo sapiens
tcacgcctgtaatcctagcagttt

SEQ ID NO: 15096 - DNA, 32 bp, Homo sapiens
ctgagggtcctgctgctggccccaccaaatac

SEQ ID NO: 15097 - DNA, 16 bp, Homo sapiens
cctcttgcacccagaa

SEQ ID NO: 15098 - DNA, 22 bp, Homo sapiens
tcgcccaggctggagtacagtg

SEQ ID NO: 15099 - DNA, 32 bp, Homo sapiens
tgtcctggctggaccagccactgtgggaccaa

SEQ ID NO: 15100 - DNA, 32 bp, Homo sapiens
aacccagggccagcagtggaagcctcaagcaa

SEQ ID NO: 15101 - DNA, 23 bp, Homo sapiens
tggcctgatcttggctcactgca

SEQ ID NO: 15102 - DNA, 32 bp, Homo sapiens
cgctgttacccaggctggagtgcaatggcgca

SEQ ID NO: 15103 - DNA, 32 bp, Homo sapiens
agcagtgttcctggccatctttgctactttcc

SEQ ID NO: 15104 - DNA, 32 bp, Homo sapiens
tgcccttcaccatgagagggtgcagtgagaag

SEQ ID NO: 15105 - DNA, 32 bp, Homo sapiens
ctactcgggaggctgaggcaggggaatggcgt

SEQ ID NO: 15106 - DNA, 32 bp, Homo sapiens
acagcagtcggagacatctggcagagacaaat

SEQ ID NO: 15107 - DNA, 32 bp, Homo sapiens
ctctctcgcccaggctggagtgcaacggtacg

SEQ ID NO: 15108 - DNA, 32 bp, Homo sapiens
ctactcgggaggctgaggcaggagaatggcat

SEQ ID NO: 15109 - DNA, 32 bp, Homo sapiens
ccgtgttcaagcagttctcctgcctcagcctc

SEQ ID NO: 15110 - DNA, 32 bp, Homo sapiens
ggctaaaccgatacaggaaagctctcttagaa

SEQ ID NO: 15111 - DNA, 32 bp, Homo sapiens
cctcacagtctgtagccatctgatatcctagg

SEQ ID NO: 15112 - DNA, 32 bp, Homo sapiens
gcagggggcttggtactgtgaaatggtaactt

SEQ ID NO: 15113 - DNA, 32 bp, Homo sapiens
tgggtcaccctgtcctggatgcctctgaagag

SEQ ID NO: 15114 - DNA, 20 bp, Homo sapiens
ctgcaattcactcccactgc

SEQ ID NO: 15115 - DNA, 32 bp, Homo sapiens
tcccattgcccagcctcagtgcatttggcaaa

SEQ ID NO: 15116 - DNA, 32 bp, Homo sapiens
agaggactgggaggagaatggaggcaagaaaa

SEQ ID NO: 15117 - DNA, 32 bp, Homo sapiens
tttatcggcattgtccaaaatattttattctt

SEQ ID NO: 15118 - DNA, 32 bp, Homo sapiens
gcctccacctcctgggttcaagcgattctcct

SEQ ID NO: 15119 - DNA, 28 bp, Homo sapiens
tcttccccaagtgctgacaattaatacc

SEQ ID NO: 15120 - DNA, 32 bp, Homo sapiens
tccctgaatcaccgactggaggagagttacct

SEQ ID NO: 15121 - DNA, 18 bp, Homo sapiens
ccacaccccggacaccca

SEQ ID NO: 15122 - DNA, 32 bp, Homo sapiens
gcctccacttcctgggctcaagcgattctcct

SEQ ID NO: 15123 - DNA, 23 bp, Homo sapiens
aacatgtctcggcccctgtcccc

SEQ ID NO: 15124 - DNA, 32 bp, Homo sapiens
ctaggctcaagtgatctgcccacctcagtctc

SEQ ID NO: 15125 - DNA, 32 bp, Homo sapiens
gctctgttgcccagggtggagtgcagcggtgc

SEQ ID NO: 15126 - DNA, 32 bp, Homo sapiens
ccctgttgcccaggctggagtatagtagtgca

SEQ ID NO: 15127 - DNA, 29 bp, Homo sapiens
ctctatggcccaggctggagcgcagcggt

SEQ ID NO: 15128 - DNA, 17 bp, Homo sapiens
gcccagcactgtccagg

SEQ ID NO: 15129 - DNA, 32 bp, Homo sapiens
gagcccaggcggttgaggctgcagtgagccat

SEQ ID NO: 15130 - DNA, 32 bp, Homo sapiens
taaagtggctcttggggaaaagcaatttaatg

SEQ ID NO: 15131 - DNA, 32 bp, Homo sapiens
cagcctcctgagtagctggattacaggcatgt

SEQ ID NO: 15132 - DNA, 32 bp, Homo sapiens
agcctctcgagtagctgggactacaggcgtga

SEQ ID NO: 15133 - DNA, 32 bp, Homo sapiens
gctctgttgcccaggctggagtgcagtggcga

SEQ ID NO: 15134 - DNA, 32 bp, Homo sapiens
cagggacctcttctcccagaggatcctggagc

SEQ ID NO: 15135 - DNA, 32 bp, Homo sapiens
aggagaaaatgaggagaaagacaagaaatttc

SEQ ID NO: 15136 - DNA, 32 bp, Homo sapiens
ctcaagcaattcgacatctcaagtgagacatg

SEQ ID NO: 15137 - DNA, 32 bp, Homo sapiens
acccaccaaggaagacaaagaaaaacaatgaa

SEQ ID NO: 15138 - DNA, 32 bp, Homo sapiens
ttaagcatctttatgaaacaggcacagtaccc

SEQ ID NO: 15139 - DNA, 32 bp, Homo sapiens
ctggatgctcatcagctccttctgcctccccc

SEQ ID NO: 15140 - DNA, 32 bp, Homo sapiens
agaaagatggcttcccttctggaacaccagca

SEQ ID NO: 15141 - DNA, 32 bp, Homo sapiens
gtacttaaagcacctgtggagtgcggtcgctc

SEQ ID NO: 15142 - DNA, 32 bp, Homo sapiens
actgcctgaatacaggctttaggttcccctgg

SEQ ID NO: 15143 - DNA, 32 bp, Homo sapiens
gaatctgggaggcggaggttgcagtgagccag

SEQ ID NO: 15144 - DNA, 32 bp, Homo sapiens
tgcaatgtccagcagtctgataaactgacgat

SEQ ID NO: 15145 - DNA, 32 bp, Homo sapiens
cgcagtgggctacaaactttcgcagcgcgagt

SEQ ID NO: 15146 - DNA, 32 bp, Homo sapiens
agcctcctgagtagctgagattacaggcacac

SEQ ID NO: 15147 - DNA, 32 bp, Homo sapiens
accaacagccattcatcatctgatctctgctg

SEQ ID NO: 15148 - DNA, 32 bp, Homo sapiens
tttaagtgcttttcttcttgcccacaaactag

SEQ ID NO: 15149 - DNA, 32 bp, Homo sapiens
atacacattcttctcctagcacatggatcttt

SEQ ID NO: 15150 - DNA, 32 bp, Homo sapiens
ctgacgtcaagcaatcccccagcctcggcctc

SEQ ID NO: 15151 - DNA, 32 bp, Homo sapiens
ctctgtcgtccaggctggagtgcagtgactca

SEQ ID NO: 15152 - DNA, 32 bp, Homo sapiens
ggtgtgctgctgctgctccccagcccaccagt

SEQ ID NO: 15153 - DNA, 32 bp, Homo sapiens
ctttatttgctgctgtttaagttgccaacctc

SEQ ID NO: 15154 - DNA, 32 bp, Homo sapiens
agcagcgagaggcagaggcggcggcggcgggg

SEQ ID NO: 15155 - DNA, 32 bp, Homo sapiens
acctcatttgaatcgccctcccatgggaatcc

SEQ ID NO: 15156 - DNA, 32 bp, Homo sapiens
tagatgggacgtgatggatggaattgaagtta

SEQ ID NO: 15157 - DNA, 32 bp, Homo sapiens
ctcttgttgcccaggctggagtgcagtagcac

SEQ ID NO: 15158 - DNA, 32 bp, Homo sapiens
gaacctgggaggcagaagttgcagtgagccga

SEQ ID NO: 15159 - DNA, 32 bp, Homo sapiens
cccagctcaagcaatcctcccacctcagcctc

SEQ ID NO: 15160 - DNA, 32 bp, Homo sapiens
tgccaggcaacaggactaaactacctccaaag

SEQ ID NO: 15161 - DNA, 32 bp, Homo sapiens
gagagatgcccaggttgcacaggagtgggatg

SEQ ID NO: 15162 - DNA, 32 bp, Homo sapiens
aggaagaggatgaagatgaagaataatggcta

SEQ ID NO: 15163 - DNA, 32 bp, Homo sapiens
tagcaagaagcagaggaaagaaaccaattgcc

SEQ ID NO: 15164 - DNA, 32 bp, Homo sapiens
ctctcttgtccaaggctggagtgtagtagtgc

SEQ ID NO: 15165 - DNA, 26 bp, Homo sapiens
ccttagcaaggggctcagaacacccc

SEQ ID NO: 15166 - DNA, 32 bp, Homo sapiens
cccgcctctcccctccccatcagacccatccc

SEQ ID NO: 15167 - DNA, 32 bp, Homo sapiens
gtacagcttcttctcctcacccagtttggcca

SEQ ID NO: 15168 - DNA, 32 bp, Homo sapiens
tcccagttctgcggctggagtgggtgggtgca

SEQ ID NO: 15169 - DNA, 32 bp, Homo sapiens
aggagatggagtttcactgtgtcagccaggat

SEQ ID NO: 15170 - DNA, 32 bp, Homo sapiens
ttgagacggagtttcgctcttggtgcccaggc

SEQ ID NO: 15171 - DNA, 32 bp, Homo sapiens
ctctgtcgcccaggctgtagtgcaatggcgca

SEQ ID NO: 15172 - DNA, 32 bp, Homo sapiens
gctgagcgtccaggctgcgcgatggcacacac

SEQ ID NO: 15173 - DNA, 32 bp, Homo sapiens
tgttgttgcccaggctggagtgcaatggcacg

SEQ ID NO: 15174 - DNA, 32 bp, Homo sapiens
cggcaatcgagtggcttcctggccatggagag

SEQ ID NO: 15175 - DNA, 28 bp, Homo sapiens
tgatcacccatggctgcctctcctatta

SEQ ID NO: 15176 - DNA, 32 bp, Homo sapiens
cagggtcccagtgccctctggacactatgcca

SEQ ID NO: 15177 - DNA, 32 bp, Homo sapiens
cctaggatgcccagggctgggtgcagccagct

SEQ ID NO: 15178 - DNA, 32 bp, Homo sapiens
gctctgttgcccaggctgaagtgtagtggcac

SEQ ID NO: 15179 - DNA, 31 bp, Homo sapiens
cagaccatggcagagttctcccagaaacggg

SEQ ID NO: 15180 - DNA, 32 bp, Homo sapiens
atcaattgtaggtcatgtattttactatatgt

SEQ ID NO: 15181 - DNA, 23 bp, Homo sapiens
tcgtgggtgcaccctggacccca

SEQ ID NO: 15182 - DNA, 32 bp, Homo sapiens
cttgggcacctggcactcaagcactttgcacg

SEQ ID NO: 15183 - DNA, 32 bp, Homo sapiens
aagagccttctctcttcctgttgacacttgcc

SEQ ID NO: 15184 - DNA, 22 bp, Homo sapiens
cccaaagcctaggagcttggca

SEQ ID NO: 15185 - DNA, 32 bp, Homo sapiens
acctctcaaggcccagcttcagcctcaccttc

SEQ ID NO: 15186 - DNA, 32 bp, Homo sapiens
taaaagccagttctgtggtgatgacctatgga

SEQ ID NO: 15187 - DNA, 32 bp, Homo sapiens
agtgattctgtttgccttttgttttcattggt

SEQ ID NO: 15188 - DNA, 25 bp, Homo sapiens
cagactcaataccagacactacagc

SEQ ID NO: 15189 - DNA, 32 bp, Homo sapiens
gagtgttacaggctctaaagtgcaatggagaa

SEQ ID NO: 15190 - DNA, 32 bp, Homo sapiens
atctgtcgcccaggctggagtgcagtagcgtg

SEQ ID NO: 15191 - DNA, 32 bp, Homo sapiens
tcttctagaagagagaaggaggaaaagaagca

SEQ ID NO: 15192 - DNA, 32 bp, Homo sapiens
aggccagtgcccaggttagtgagcagtgcccg

SEQ ID NO: 15193 - DNA, 32 bp, Homo sapiens
tcctccgactccctggttcaagcgattgtcct

SEQ ID NO: 15194 - DNA, 32 bp, Homo sapiens
actgaaaggaaaggagaaacagataagtccat

SEQ ID NO: 15195 - DNA, 32 bp, Homo sapiens
ttccttcacaccaattctcctcctgagacgga

SEQ ID NO: 15196 - DNA, 32 bp, Homo sapiens
ggctcatgcttgtaatcccagcactttggtag

SEQ ID NO: 15197 - DNA, 32 bp, Homo sapiens
cggtctggagcctctgggcttctgcctacaga

SEQ ID NO: 15198 - DNA, 32 bp, Homo sapiens
cccttgcgccttctcccacagggcccagcccc

SEQ ID NO: 15199 - DNA, 24 bp, Homo sapiens
ggtgtttgtggactggttcaggga

SEQ ID NO: 15200 - DNA, 32 bp, Homo sapiens
ctctctggcccaagctggagtgcagtggcacg

SEQ ID NO: 15201 - DNA, 32 bp, Homo sapiens
ctgagagctctctcttctctgttacaaaacga

SEQ ID NO: 15202 - DNA, 32 bp, Homo sapiens
aattttcccaaaactgataccctttgaaaaag

SEQ ID NO: 15203 - DNA, 32 bp, Homo sapiens
ccccacgcggagccagcgctgcagtgaaagag

SEQ ID NO: 15204 - DNA, 32 bp, Homo sapiens
gaacctgggaggcggaagttgcagtgagccga

SEQ ID NO: 15205 - DNA, 32 bp, Homo sapiens
ctataatgccccatttcatctgattgatgacc

SEQ ID NO: 15206 - DNA, 29 bp, Homo sapiens
actctgttgcccaggctggagtgcagtgg

SEQ ID NO: 15207 - DNA, 32 bp, Homo sapiens
gaacctggaaggcggaggttgcagtgagccga

SEQ ID NO: 15208 - DNA, 32 bp, Homo sapiens
gtttctgtctttctcccctgggctcctgtctc

SEQ ID NO: 15209 - DNA, 32 bp, Homo sapiens
tttcaacatcttctccagccagtttactggaa

SEQ ID NO: 15210 - DNA, 32 bp, Homo sapiens
ctgagttcaagcagtcctcctgcttcaacata

SEQ ID NO: 15211 - DNA, 32 bp, Homo sapiens
tacaaagcaattcataccttttgctacatttg

SEQ ID NO: 15212 - DNA, 23 bp, Homo sapiens
tgacaggatctcggctcactgca

SEQ ID NO: 15213 - DNA, 32 bp, Homo sapiens
cctgccctcagagaggttccagtctagatgag

SEQ ID NO: 15214 - DNA, 32 bp, Homo sapiens
gggtagtacccagcctgctccccgagtccagc

SEQ ID NO: 15215 - DNA, 28 bp, Homo sapiens
acctacaagtggtttgcctcattgcctt

SEQ ID NO: 15216 - DNA, 32 bp, Homo sapiens
gaacccgggaggtggaggttgcggtgagctga

SEQ ID NO: 15217 - DNA, 32 bp, Homo sapiens
ccgctcgggaggctgaggcaggagaattgctt

SEQ ID NO: 15218 - DNA, 32 bp, Homo sapiens
gaacccgggaggtggaggttgcagtgagctaa

SEQ ID NO: 15219 - DNA, 32 bp, Homo sapiens
gaacctaggaggtggaggttgcagtgagccga

SEQ ID NO: 15220 - DNA, 32 bp, Homo sapiens
gaggctgggaggcggaggttgcagtgagctga

SEQ ID NO: 15221 - DNA, 32 bp, Homo sapiens
gaacctgggaggtggaggttgcggtgagccga

SEQ ID NO: 15222 - DNA, 32 bp, Homo sapiens
gcaattggtaatccccaaaatgggtgtatctg

SEQ ID NO: 15223 - DNA, 32 bp, Homo sapiens
gaacccaggaggtggaggttgcagtgagctga

SEQ ID NO: 15224 - DNA, 32 bp, Homo sapiens
gaacctgggaggtggaggttgcagtgagccaa

SEQ ID NO: 15225 - DNA, 21 bp, Homo sapiens
ggtctgattttgccctggggc

SEQ ID NO: 15226 - DNA, 32 bp, Homo sapiens
cactctgtctgtctccccaagctgggcagccc

SEQ ID NO: 15227 - DNA, 32 bp, Homo sapiens
aaaatccacctgtctcccatctggggctcttt

SEQ ID NO: 15228 - DNA, 32 bp, Homo sapiens
gccatagccttctcttctcaggcgtggactgc

SEQ ID NO: 15229 - DNA, 32 bp, Homo sapiens
acctcccctaaccccaaacatagatcacacct

SEQ ID NO: 15230 - DNA, 32 bp, Homo sapiens
actgaagagatagctttcaagggcccaacact

SEQ ID NO: 15231 - DNA, 32 bp, Homo sapiens
aatcgtcacccacattggagtgcagtggtacg

SEQ ID NO: 15232 - DNA, 32 bp, Homo sapiens
tctcctgtggctctgccatcagctccaatatc

SEQ ID NO: 15233 - DNA, 32 bp, Homo sapiens
tctgctcatccctcctcattcagacatcctcc

SEQ ID NO: 15234 - DNA, 32 bp, Homo sapiens
atctccacctcctgggttcaagcaattttctt

SEQ ID NO: 15235 - DNA, 28 bp, Homo sapiens
ccagttccaagtgcatcccttattctat

SEQ ID NO: 15236 - DNA, 32 bp, Homo sapiens
ctgtcacccccaggccagagtgcagtggtgca

SEQ ID NO: 15237 - DNA, 32 bp, Homo sapiens
ggaggaaacttccttccatcttctctgcataa

SEQ ID NO: 15238 - DNA, 32 bp, Homo sapiens
acaaatttcatttccatttaagcaatttgtaa

SEQ ID NO: 15239 - DNA, 32 bp, Homo sapiens
tagggttgtgactggctttggtgcaaatgtgt

SEQ ID NO: 15240 - DNA, 32 bp, Homo sapiens
ggctcatgcctgtaatcccagcactttggcag

SEQ ID NO: 15241 - DNA, 32 bp, Homo sapiens
ggctcgtgcctgtcatcccagcactttgggag

SEQ ID NO: 15242 - DNA, 32 bp, Homo sapiens
agtgtggtgctgctaacattgcccaggcaaca

SEQ ID NO: 15243 - DNA, 32 bp, Homo sapiens
agctccgtcggtctttctcttctcttttaaga

SEQ ID NO: 15244 - DNA, 32 bp, Homo sapiens
gaccgctctgcagtaccagctcctctgtctcc

SEQ ID NO: 15245 - DNA, 32 bp, Homo sapiens
ctctcacacccaggctggagtgcagtctcaac

SEQ ID NO: 15246 - DNA, 32 bp, Homo sapiens
gtttctccagttctgcctgccctggcagaatc

SEQ ID NO: 15247 - DNA, 32 bp, Homo sapiens
tcttgggtgccagcagagccattcagtacaac

SEQ ID NO: 15248 - DNA, 32 bp, Homo sapiens
gtcgcggacgcaatggcttcaaggttacttcg

SEQ ID NO: 15249 - DNA, 32 bp, Homo sapiens
ggggtgggtgcccgaaggttgcatgatggaat

SEQ ID NO: 15250 - DNA, 32 bp, Homo sapiens
taaagcccaagtgttctttagctttttataat

SEQ ID NO: 15251 - DNA, 32 bp, Homo sapiens
gtggcccacgttctactcatctggagcccagg

SEQ ID NO: 15252 - DNA, 32 bp, Homo sapiens
ctgggcttaagcagtcttcccacctcagcctc

SEQ ID NO: 15253 - DNA, 32 bp, Homo sapiens
gcaagaaaggaaaggatcctgtggaagggtct

SEQ ID NO: 15254 - DNA, 23 bp, Homo sapiens
tggcaccatctcagctcactgcg

SEQ ID NO: 15255 - DNA, 32 bp, Homo sapiens
ctcactcttcaaggaggcccacttgtgtctta

SEQ ID NO: 15256 - DNA, 32 bp, Homo sapiens
cagtccccaggacagggtcaccacctttctct

SEQ ID NO: 15257 - DNA, 28 bp, Homo sapiens
cccccaccaagtgcggacgcatcgagct

SEQ ID NO: 15258 - DNA, 32 bp, Homo sapiens
cgcgcaccagtcgcgtaagacaacagcagtgt

SEQ ID NO: 15259 - DNA, 32 bp, Homo sapiens
tgtcagcccttgaacatctcctccaaagagac

SEQ ID NO: 15260 - DNA, 32 bp, Homo sapiens
ctgatcaatgacaccttcctggtaacatttca

SEQ ID NO: 15261 - DNA, 32 bp, Homo sapiens
tttctgcaggactccttcctggcactctctcc

SEQ ID NO: 15262 - DNA, 32 bp, Homo sapiens
attcagttgagtgcagcatctttcccacattc

SEQ ID NO: 15263 - DNA, 32 bp, Homo sapiens
agttagaaaaattggcctcagtgtgaaatttt

SEQ ID NO: 15264 - DNA, 32 bp, Homo sapiens
ggctcagcctccagattaactgggtctcactc

SEQ ID NO: 15265 - DNA, 32 bp, Homo sapiens
gcagggaagctttcaccagccacacaagggtc

SEQ ID NO: 15266 - DNA, 32 bp, Homo sapiens
tgtctgtgtctcctcttctgtctcttagaagg

SEQ ID NO: 15267 - DNA, 32 bp, Homo sapiens
ttaggccaccttctccctttcctggaccccag

SEQ ID NO: 15268 - DNA, 32 bp, Homo sapiens
ctctgaggtactctgctcacaggccccagaca

SEQ ID NO: 15269 - DNA, 32 bp, Homo sapiens
cctccttccctctcttctgcctgatagaggga

SEQ ID NO: 15270 - DNA, 24 bp, Homo sapiens
gtcacccaggctggagtacaatga

SEQ ID NO: 15271 - DNA, 32 bp, Homo sapiens
ctctatggcccaggctggagtacagtgacacg

SEQ ID NO: 15272 - DNA, 24 bp, Homo sapiens
tggcgccgtctcggctcactacag

SEQ ID NO: 15273 - DNA, 32 bp, Homo sapiens
taaaatgtgctgcccttcacagatgacaccac

SEQ ID NO: 15274 - DNA, 32 bp, Homo sapiens
ttttgtgggaggcagcatggcaccgtggaaag

SEQ ID NO: 15275 - DNA, 32 bp, Homo sapiens
gctctgttgcccaggctgaagtgcagtggggc

SEQ ID NO: 15276 - DNA, 32 bp, Homo sapiens
ctgttgttgcccaggctggagtgcaatggcgt

SEQ ID NO: 15277 - DNA, 32 bp, Homo sapiens
cgccctgtcgccaggctggagtgtagtggcat

SEQ ID NO: 15278 - DNA, 32 bp, Homo sapiens
ggctcactactgtaattccagcactttgggag

SEQ ID NO: 15279 - DNA, 32 bp, Homo sapiens
ccctgaatctctgcatatgagcatttttctgg

SEQ ID NO: 15280 - DNA, 32 bp, Homo sapiens
agcctcctgagtagctgggattacagctctgg

SEQ ID NO: 15281 - DNA, 32 bp, Homo sapiens
acttgctctgcagccactcagtagtcttctgt

SEQ ID NO: 15282 - DNA, 31 bp, Homo sapiens
tctgaaactcacacaactaggaagtggctga

SEQ ID NO: 15283 - DNA, 22 bp, Homo sapiens
atgcctgtaatcccggcacttt

SEQ ID NO: 15284 - DNA, 32 bp, Homo sapiens
tgctcttacccaggctgagtgcagtggcagaa

SEQ ID NO: 15285 - DNA, 32 bp, Homo sapiens
atccagagactttatcttatctctacataaca

SEQ ID NO: 15286 - DNA, 20 bp, Homo sapiens
cagaaggaaccctccagtcc

SEQ ID NO: 15287 - DNA, 28 bp, Homo sapiens
agaggcccaggatgagcctcatcttgtc

SEQ ID NO: 15288 - DNA, 23 bp, Homo sapiens
tgatgcaatctcggctcactgca

SEQ ID NO: 15289 - DNA, 32 bp, Homo sapiens
tgtagaagtagaaagaaaagaaaaagaaaatc

SEQ ID NO: 15290 - DNA, 32 bp, Homo sapiens
gagtcaggctgttgcgctcccacctcagcccc

SEQ ID NO: 15291 - DNA, 32 bp, Homo sapiens
gagggtggtagaggagataagacagtagggaa

SEQ ID NO: 15292 - DNA, 32 bp, Homo sapiens
aatttttggtatagggtcatctctccaccttg

SEQ ID NO: 15293 - DNA, 32 bp, Homo sapiens
agctgtagtgccattagaaactgtgaatttcc

SEQ ID NO: 15294 - DNA, 32 bp, Homo sapiens
ctttgttgcccaggctggagtgcagtggcacg

SEQ ID NO: 15295 - DNA, 32 bp, Homo sapiens
ctctgtcacttaggctggagtgcagtggcgtg

SEQ ID NO: 15296 - DNA, 32 bp, Homo sapiens
ctttgttacccaggctggagtgcagtggcaca

SEQ ID NO: 15297 - DNA, 32 bp, Homo sapiens
gcagagtgacccagactgcaggcagtaactga

SEQ ID NO: 15298 - DNA, 32 bp, Homo sapiens
acatgactcccagtgaggagaattcaggtgat

SEQ ID NO: 15299 - DNA, 32 bp, Homo sapiens
ttcctgagccccacctgcttcatgggttggct

SEQ ID NO: 15300 - DNA, 32 bp, Homo sapiens
gtggtgggtcctgctcctatctctccaaaccc

SEQ ID NO: 15301 - DNA, 32 bp, Homo sapiens
tcatgctgagcgctctcttaggcacaggctgg

SEQ ID NO: 15302 - DNA, 32 bp, Homo sapiens
tcagacaatgccttctccattacttgaagctt

SEQ ID NO: 15303 - DNA, 32 bp, Homo sapiens
gaaccctggaggcagaggttgcaatgagccga

SEQ ID NO: 15304 - DNA, 32 bp, Homo sapiens
gaacctgggaggcaaaggttgcggtgaactga

SEQ ID NO: 15305 - DNA, 32 bp, Homo sapiens
gctctgtcacttgggttggagtgcagttgcag

SEQ ID NO: 15306 - DNA, 18 bp, Homo sapiens
ctgtaatcccagcacttt

SEQ ID NO: 15307 - DNA, 32 bp, Homo sapiens
gaacctgggaggcagaggttgcagtgaactga

SEQ ID NO: 15308 - DNA, 32 bp, Homo sapiens
gaacccaggagacagaggttgcagtgagccaa

SEQ ID NO: 15309 - DNA, 32 bp, Homo sapiens
ggcaggtggaaaaccatctcccagaaacctga

SEQ ID NO: 15310 - DNA, 32 bp, Homo sapiens
caatcccctcaaggatctgcattcaggcctgc

SEQ ID NO: 15311 - DNA, 24 bp, Homo sapiens
tcacacctgtaatcccaacatttt

SEQ ID NO: 15312 - DNA, 32 bp, Homo sapiens
gaggctgagaggtcaaggttgcagtgagccat

SEQ ID NO: 15313 - DNA, 32 bp, Homo sapiens
tcaatcctttaccaactgtcccatgaagagta

SEQ ID NO: 15314 - DNA, 32 bp, Homo sapiens
tttttctgagtataatgttattacatggtcct

SEQ ID NO: 15315 - DNA, 32 bp, Homo sapiens
gaacccggaaggcggagcttgcagtgagccga

SEQ ID NO: 15316 - DNA, 32 bp, Homo sapiens
gaacctggaaggcggagcttgcagtgagctga

SEQ ID NO: 15317 - DNA, 32 bp, Homo sapiens
actctatcacccaggctggagtgcagtgtggc

SEQ ID NO: 15318 - DNA, 32 bp, Homo sapiens
tggggctcaagcagttctcccaccagcctcct

SEQ ID NO: 15319 - DNA, 32 bp, Homo sapiens
ggcttatgcttgtaatcccagcactttgggag

SEQ ID NO: 15320 - DNA, 32 bp, Homo sapiens
cagagtttcacctgcccacacagggtccgttg

SEQ ID NO: 15321 - DNA, 32 bp, Homo sapiens
aaggtttctgaggacttctcccaggagaagac

SEQ ID NO: 15322 - DNA, 32 bp, Homo sapiens
ggaagaggaagaggaagagaggaagcggaggg

SEQ ID NO: 15323 - DNA, 32 bp, Homo sapiens
tgctgttgcccaggctggagtgcagtggtgcg

SEQ ID NO: 15324 - DNA, 32 bp, Homo sapiens
ccgtactggaggctagctcttgtcgcggccgc

SEQ ID NO: 15325 - DNA, 19 bp, Homo sapiens
gcaaatgaaaactctctcc

SEQ ID NO: 15326 - DNA, 32 bp, Homo sapiens
gaacctgtgaggaagaggttgcagtgagctga

SEQ ID NO: 15327 - DNA, 32 bp, Homo sapiens
gcagcgtccagtgccctgccagtagctcctag

SEQ ID NO: 15328 - DNA, 32 bp, Homo sapiens
gaacccaggaggcggaggttgcagtgagacga

SEQ ID NO: 15329 - DNA, 32 bp, Homo sapiens
gttgcaatgaggcaaaggatgcagtgactttt

SEQ ID NO: 15330 - DNA, 32 bp, Homo sapiens
gaacctgggaggagaaggttgcagtgagctga

SEQ ID NO: 15331 - DNA, 32 bp, Homo sapiens
ccaggttcaagcaaaagacccacctctctgca

SEQ ID NO: 15332 - DNA, 32 bp, Homo sapiens
cgcccacgcttaacaggaagctcctaggcctc

SEQ ID NO: 15333 - DNA, 32 bp, Homo sapiens
cgctctgtctccaggctggagtgcagtggcgt

SEQ ID NO: 15334 - DNA, 32 bp, Homo sapiens
ataagctatattttccccttgtttttaaaagg

SEQ ID NO: 15335 - DNA, 19 bp, Homo sapiens
cagagagctcctccagcct

SEQ ID NO: 15336 - DNA, 32 bp, Homo sapiens
gcattggcttgtctgccgcaggcacagaaggg

SEQ ID NO: 15337 - DNA, 32 bp, Homo sapiens
ctctgtcacccaggctggcgtgcaatggcgca

SEQ ID NO: 15338 - DNA, 32 bp, Homo sapiens
ctggcggactcaggctggggtctgcagtgcag

SEQ ID NO: 15339 - DNA, 32 bp, Homo sapiens
attctggccatttgagcattctctccaactct

SEQ ID NO: 15340 - DNA, 32 bp, Homo sapiens
gaacccaggaggcggagcttgcagtgagccaa

SEQ ID NO: 15341 - DNA, 32 bp, Homo sapiens
gaacccgggcggcggagattgcagtgagccga

SEQ ID NO: 15342 - DNA, 32 bp, Homo sapiens
ggactgcaacatcacggatggtgactactacg

SEQ ID NO: 15343 - DNA, 32 bp, Homo sapiens
gaacccgggaggcggagcttgcagtgagccga

SEQ ID NO: 15344 - DNA, 32 bp, Homo sapiens
gaacccgggaggcggaggttgcagtcagccga

SEQ ID NO: 15345 - DNA, 32 bp, Homo sapiens
gaacctgggaggcggagcttgcagtgagctga

SEQ ID NO: 15346 - DNA, 32 bp, Homo sapiens
gatagaagtgctcgggaaagaaagcaaagcgg

SEQ ID NO: 15347 - DNA, 32 bp, Homo sapiens
ccggtcgtctcaaattcatctgatctcttatt

SEQ ID NO: 15348 - DNA, 32 bp, Homo sapiens
ggagacccaagtgggcccggcgccaacggctc

SEQ ID NO: 15349 - DNA, 32 bp, Homo sapiens
tggctccaggatgttaggaactgtgaagatgg

SEQ ID NO: 15350 - DNA, 32 bp, Homo sapiens
atcctagagccagctgataatatttaataatc

SEQ ID NO: 15351 - DNA, 32 bp, Homo sapiens
cagccagagcctgtctttcagcattcagtcgc

SEQ ID NO: 15352 - DNA, 32 bp, Homo sapiens
ttaccaggcccaggctggggtggtgtgaaccc

SEQ ID NO: 15353 - DNA, 32 bp, Homo sapiens
atctggatgtgaagagaaagagaaaaacaaaa

SEQ ID NO: 15354 - DNA, 32 bp, Homo sapiens
gacattccagttctgcggcccagacggcagaa

SEQ ID NO: 15355 - DNA, 32 bp, Homo sapiens
atcctccaagaattaaatgataagctaggatt

SEQ ID NO: 15356 - DNA, 32 bp, Homo sapiens
tcctctgcctcccgggttcaagcaattctcct

SEQ ID NO: 15357 - DNA, 32 bp, Homo sapiens
gccctgttgcccatgctggagtgcaatggcac

SEQ ID NO: 15358 - DNA, 32 bp, Homo sapiens
caggaggccagagtgaggggtccgttctgtcc

SEQ ID NO: 15359 - DNA, 32 bp, Homo sapiens
gaacccaagaggcagagtttgcagtgagctga

SEQ ID NO: 15360 - DNA, 32 bp, Homo sapiens
atgtttaactgcagacttgccttaaaacaaga

SEQ ID NO: 15361 - DNA, 32 bp, Homo sapiens
tgctctgtcaccaggctggagtgcagcggcgc

SEQ ID NO: 15362 - DNA, 32 bp, Homo sapiens
tgctctgtcatcaggctggagtgcagtggcgc

SEQ ID NO: 15363 - DNA, 32 bp, Homo sapiens
tgagaacctcaaggaggagctggcctacctga

SEQ ID NO: 15364 - DNA, 32 bp, Homo sapiens
accacacatggtctccccacctggtttcagct

SEQ ID NO: 15365 - DNA, 32 bp, Homo sapiens
aatctgtcacccaggctggagcgcagtggtgt

SEQ ID NO: 15366 - DNA, 32 bp, Homo sapiens
cactgtcacccagtctggagtggagtggcata

SEQ ID NO: 15367 - DNA, 32 bp, Homo sapiens
tcttattgcccaggctggagtgcagtggcgtg

SEQ ID NO: 15368 - DNA, 32 bp, Homo sapiens
aaagaattggcctggctgggtgcagtggctca

SEQ ID NO: 15369 - DNA, 32 bp, Homo sapiens
actctgtcacacaggctggagtgcagtacaat

SEQ ID NO: 15370 - DNA, 32 bp, Homo sapiens
gagcccaggaggcagaatttgcagtgagctga

SEQ ID NO: 15371 - DNA, 32 bp, Homo sapiens
gagcccaggagctggaggctgcagtgaactat

SEQ ID NO: 15372 - DNA, 32 bp, Homo sapiens
catgaatcaagcaatccagcctcatgggaagt

SEQ ID NO: 15373 - DNA, 32 bp, Homo sapiens
ctggggccaagtgatcctcccacctcagcctc

SEQ ID NO: 15374 - DNA, 32 bp, Homo sapiens
aacctcctgagtagctgggactacaggcacct

SEQ ID NO: 15375 - DNA, 32 bp, Homo sapiens
ttctgaaatttccatattgagagaagccaaac

SEQ ID NO: 15376 - DNA, 32 bp, Homo sapiens
cctgggagaagaggaaaaaggagctaatattt

SEQ ID NO: 15377 - DNA, 32 bp, Homo sapiens
gtgttttcaagcacaacccaccacaacaagca

SEQ ID NO: 15378 - DNA, 32 bp, Homo sapiens
cccattcccatctactgaaacagggtctccac

SEQ ID NO: 15379 - DNA, 32 bp, Homo sapiens
accatttttgcagctttaatccttagcctctt

SEQ ID NO: 15380 - DNA, 32 bp, Homo sapiens
ggtacacgctttctccccagacggcacccact

SEQ ID NO: 15381 - DNA, 32 bp, Homo sapiens
aattgccctgcaggctggagtgcagcggcatg

SEQ ID NO: 15382 - DNA, 32 bp, Homo sapiens
tgtcacccaggctggagtgcagtggcgcaatc

SEQ ID NO: 15383 - DNA, 20 bp, Homo sapiens
gggctccaactcctccttgc

SEQ ID NO: 15384 - DNA, 32 bp, Homo sapiens
aaggccaggagtttgaggctgcagtgagctat

SEQ ID NO: 15385 - DNA, 32 bp, Homo sapiens
gcatcatttcatgccaaagtgctgctatgggc

SEQ ID NO: 15386 - DNA, 32 bp, Homo sapiens
accttctgtaccatgccttcagaaaccttctt

SEQ ID NO: 15387 - DNA, 32 bp, Homo sapiens
gattataaacaacagaaacttctcagttttgg

SEQ ID NO: 15388 - DNA, 32 bp, Homo sapiens
gctctgctgcccaggctggagtacagtgatgt

SEQ ID NO: 15389 - DNA, 32 bp, Homo sapiens
gtcgtgtctgggagtttctcccagagaaacca

SEQ ID NO: 15390 - DNA, 32 bp, Homo sapiens
agcctcttgagtagctgggactacaggtgccc

SEQ ID NO: 15391 - DNA, 32 bp, Homo sapiens
atcctccggagtagctgggattacaggcgcct

SEQ ID NO: 15392 - DNA, 32 bp, Homo sapiens
tgaaggaagaattctatggaaattacaaatcc

SEQ ID NO: 15393 - DNA, 32 bp, Homo sapiens
tttggctctctgccttctcttcatgttggcct

SEQ ID NO: 15394 - DNA, 32 bp, Homo sapiens
agccctcatcttctctttctctcctcagttta

SEQ ID NO: 15395 - DNA, 31 bp, Homo sapiens
aggtgtgagggcagtgcaaggagggagcaca

SEQ ID NO: 15396 - DNA, 19 bp, Homo sapiens
gaccaacatggtgaaaccc

SEQ ID NO: 15397 - DNA, 32 bp, Homo sapiens
aagaagccagatcctagccacttggagctgcc

SEQ ID NO: 15398 - DNA, 32 bp, Homo sapiens
ttgttgctgctgctgctcattccacactgttg

SEQ ID NO: 15399 - DNA, 18 bp, Homo sapiens
gcccctgccccgtgaagg

SEQ ID NO: 15400 - DNA, 32 bp, Homo sapiens
agtctcctgagtagctgggactacaggtgcgt

SEQ ID NO: 15401 - DNA, 32 bp, Homo sapiens
aaaacaacaggaagcagcttacaaactcggtg

SEQ ID NO: 15402 - DNA, 23 bp, Homo sapiens
tggcacgacctctgctcgctgca

SEQ ID NO: 15403 - DNA, 32 bp, Homo sapiens
ccgcggctgctgctgcgcaggcccagtgctgc

SEQ ID NO: 15404 - DNA, 32 bp, Homo sapiens
tcccgagacgtgtaatgacaccacacttgttt

SEQ ID NO: 15405 - DNA, 32 bp, Homo sapiens
ttaaggagaaggtcaaggctgcagtgagccat

SEQ ID NO: 15406 - DNA, 32 bp, Homo sapiens
actctgtcacccacgctggagtgctgtgatgc

SEQ ID NO: 15407 - DNA, 32 bp, Homo sapiens
agccagaggcctggggacctccttgccttccc

SEQ ID NO: 15408 - DNA, 32 bp, Homo sapiens
actcttttgcccaggctggagcgaagtgacga

SEQ ID NO: 15409 - DNA, 32 bp, Homo sapiens
aaggggcaggtgcagaggtggcagggatggct

SEQ ID NO: 15410 - DNA, 18 bp, Homo sapiens
gcccctgccctaggggtg

SEQ ID NO: 15411 - DNA, 32 bp, Homo sapiens
ctgacctcaggtgatccacccacctcagcctc

SEQ ID NO: 15412 - DNA, 32 bp, Homo sapiens
cccactctcaggccactgcccacctcactcag

SEQ ID NO: 15413 - DNA, 32 bp, Homo sapiens
acctgcctgcttgcttctctggctgcctggtc

SEQ ID NO: 15414 - DNA, 32 bp, Homo sapiens
ttcctgactgcagctctcttcattctgccaac

SEQ ID NO: 15415 - DNA, 20 bp, Homo sapiens
tgtggggatggtgatggaga

SEQ ID NO: 15416 - DNA, 32 bp, Homo sapiens
acaggatggagtttcgctctgtcgccaggctg

SEQ ID NO: 15417 - DNA, 23 bp, Homo sapiens
tggcaccatcttggctcacttca

SEQ ID NO: 15418 - DNA, 32 bp, Homo sapiens
ttccttgctttctcttctaatggaatatgcgt

SEQ ID NO: 15419 - DNA, 32 bp, Homo sapiens
cttgcctagatttaaggccactgtgaggagag

SEQ ID NO: 15420 - DNA, 32 bp, Homo sapiens
ttgcttccctatcttggctactgtgaataatg

SEQ ID NO: 15421 - DNA, 32 bp, Homo sapiens
ttgtctgcagaaccaccaccttgaaagatcca

SEQ ID NO: 15422 - DNA, 32 bp, Homo sapiens
tctccttggaggcagtggtgtgaatcttcttc

SEQ ID NO: 15423 - DNA, 28 bp, Homo sapiens
cagctcccaagtgctccctatccagtcc

SEQ ID NO: 15424 - DNA, 32 bp, Homo sapiens
gggattctgagtagcaggggcagcatgcccag

SEQ ID NO: 15425 - DNA, 32 bp, Homo sapiens
cctactgcctgagatggttccagaggcggtct

SEQ ID NO: 15426 - DNA, 32 bp, Homo sapiens
gagcccgagagacagaggttgcagtgagccga

SEQ ID NO: 15427 - DNA, 19 bp, Homo sapiens
gcaagaaggcggggagcag

SEQ ID NO: 15428 - DNA, 32 bp, Homo sapiens
aaagagataagaggaggaagctaataagagac

SEQ ID NO: 15429 - DNA, 32 bp, Homo sapiens
agcctcccaaagtgctgggattaggtgtgagc

SEQ ID NO: 15430 - DNA, 32 bp, Homo sapiens
caaataataacaaagcattaccaccttgtgtc

SEQ ID NO: 15431 - DNA, 32 bp, Homo sapiens
aaatttatctcagcttctgttagcttatcctc

SEQ ID NO: 15432 - DNA, 17 bp, Homo sapiens
ggcagccacagcagctg

SEQ ID NO: 15433 - DNA, 32 bp, Homo sapiens
aagctgagaagaggatgcagaatgacaaggaa

SEQ ID NO: 15434 - DNA, 32 bp, Homo sapiens
aactcaaatgcttggcttctcatacgtccacc

SEQ ID NO: 15435 - DNA, 32 bp, Homo sapiens
cacttcagagcctctgaggggccaccacttct

SEQ ID NO: 15436 - DNA, 32 bp, Homo sapiens
gtgggctgaggtcagaggttggtggggtgtca

SEQ ID NO: 15437 - DNA, 32 bp, Homo sapiens
tggccagggaggcattgctgcaggtgagcctg

SEQ ID NO: 15438 - DNA, 32 bp, Homo sapiens
accttggaggaggagaggttggtgacatgcat

SEQ ID NO: 15439 - DNA, 32 bp, Homo sapiens
gtttacgggaggcgcttggttacgggatccag

SEQ ID NO: 15440 - DNA, 32 bp, Homo sapiens
ttcttagcaacagaaaaatcaaacttctgtta

SEQ ID NO: 15441 - DNA, 32 bp, Homo sapiens
actctgttgcctaggctggagtacagtggcaa

SEQ ID NO: 15442 - DNA, 32 bp, Homo sapiens
actctgttgcccaggttggagtacagcaatgc

SEQ ID NO: 15443 - DNA, 32 bp, Homo sapiens
gggagggaaagaggaggaaggaagatgcgaga

SEQ ID NO: 15444 - DNA, 32 bp, Homo sapiens
ctgggctcaagcaaccctgccacctcagcctt

SEQ ID NO: 15445 - DNA, 32 bp, Homo sapiens
agcctcctgattagctgggattacaggcatgc

SEQ ID NO: 15446 - DNA, 32 bp, Homo sapiens
gtgacccttcaaggagttcagacctgggggct

SEQ ID NO: 15447 - DNA, 32 bp, Homo sapiens
cccgctctgcaggccgcccttctgccagctgg

SEQ ID NO: 15448 - DNA, 21 bp, Homo sapiens
tatgcctgtaatcccagcact

SEQ ID NO: 15449 - DNA, 32 bp, Homo sapiens
ttgagacggagtttcacgcttattgcccaggc

SEQ ID NO: 15450 - DNA, 32 bp, Homo sapiens
cccggggagccagctggcctggggttcggtcc

SEQ ID NO: 15451 - DNA, 32 bp, Homo sapiens
gtggcagccctctctttccagggcaaggtctg

SEQ ID NO: 15452 - DNA, 32 bp, Homo sapiens
acctctgcctcctgggttcaagcagttctcct

SEQ ID NO: 15453 - DNA, 32 bp, Homo sapiens
ctcttgttgtccagtctggagtgcaatggcac

SEQ ID NO: 15454 - DNA, 32 bp, Homo sapiens
ccgggctgtcccaggctgaggcggttgctccc

SEQ ID NO: 15455 - DNA, 32 bp, Homo sapiens
ctacctcatggagtattctcccagaaactgca

SEQ ID NO: 15456 - DNA, 32 bp, Homo sapiens
ctgggctcaagcaattcactcgcctcggcctc

SEQ ID NO: 15457 - DNA, 32 bp, Homo sapiens
ggcctcccaaagtgctgggattcccggcgtga

SEQ ID NO: 15458 - DNA, 32 bp, Homo sapiens
agcctcccaagtagctgggattacagttccca

SEQ ID NO: 15459 - DNA, 32 bp, Homo sapiens
gagtgtcttttagtgtcacagggaacagttat

SEQ ID NO: 15460 - DNA, 20 bp, Homo sapiens
gccaccactgccactcggga

SEQ ID NO: 15461 - DNA, 20 bp, Homo sapiens
gggtgaagccagaggtggct

SEQ ID NO: 15462 - DNA, 23 bp, Homo sapiens
tggcgcgatcttgactcactgca

SEQ ID NO: 15463 - DNA, 23 bp, Homo sapiens
tggtgcgatctcgactcactgca

SEQ ID NO: 15464 - DNA, 32 bp, Homo sapiens
cagcatgtgctgctgcctttgtaactgcatgg

SEQ ID NO: 15465 - DNA, 28 bp, Homo sapiens
tcttggtctcaagttgcctcattgcggc

SEQ ID NO: 15466 - DNA, 32 bp, Homo sapiens
gctctgtcacttaggctggagtgcagtggcgt

SEQ ID NO: 15467 - DNA, 32 bp, Homo sapiens
aggagtgcctaagccaggacccagaaactcag

SEQ ID NO: 15468 - DNA, 32 bp, Homo sapiens
ctgaaatggaggcagaggtgtgggaggcagaa

SEQ ID NO: 15469 - DNA, 32 bp, Homo sapiens
ctttagctccatagttctcttctcgcctcata

SEQ ID NO: 15470 - DNA, 32 bp, Homo sapiens
caggtcctgggagaggacagaaaacaactgga

SEQ ID NO: 15471 - DNA, 32 bp, Homo sapiens
cactgtgcaacacaggcttcagattcatgtat

SEQ ID NO: 15472 - DNA, 32 bp, Homo sapiens
ggagtcttgctgctgcatgttccaggctccac

SEQ ID NO: 15473 - DNA, 32 bp, Homo sapiens
ccgtctggcctaaaggtgatgtatttggtgtt

SEQ ID NO: 15474 - DNA, 32 bp, Homo sapiens
gcgggaggtgcctctttagaaaccacgaagtg

SEQ ID NO: 15475 - DNA, 32 bp, Homo sapiens
gaagtctcagttctgtcatttgtcctggagca

SEQ ID NO: 15476 - DNA, 19 bp, Homo sapiens
tggcacaatccctcactgc

SEQ ID NO: 15477 - DNA, 32 bp, Homo sapiens
gccttgctgctgctgcacccaactactgagct

SEQ ID NO: 15478 - DNA, 32 bp, Homo sapiens
acttccacctcccaggttcaagcgattcttat

SEQ ID NO: 15479 - DNA, 32 bp, Homo sapiens
atggttcctagagcctgggggtcaagtgttcc

SEQ ID NO: 15480 - DNA, 32 bp, Homo sapiens
gaacccgggaggcagaggttgtagtgagccca

SEQ ID NO: 15481 - DNA, 32 bp, Homo sapiens
gtgaccggctctggaagttcccatgaatggac

SEQ ID NO: 15482 - DNA, 32 bp, Homo sapiens
cgcgcctgggagggagaaagaagtcgggggcc

SEQ ID NO: 15483 - DNA, 32 bp, Homo sapiens
tcctgatcgagagattcacccacctcggcctc

SEQ ID NO: 15484 - DNA, 32 bp, Homo sapiens
agacactcacacaattctcaatccacatttca

SEQ ID NO: 15485 - DNA, 32 bp, Homo sapiens
cagaaaaagagtttttctcttgttcagcctgc

SEQ ID NO: 15486 - DNA, 32 bp, Homo sapiens
gcaatcattgcagcttcttctttcttctgctc

SEQ ID NO: 15487 - DNA, 24 bp, Homo sapiens
tcaggcctgtaatctcagcacttt

SEQ ID NO: 15488 - DNA, 32 bp, Homo sapiens
tgaattggtcccagctgctcccagaagaacgg

SEQ ID NO: 15489 - DNA, 32 bp, Homo sapiens
aaaacaacaacaacactatcctataaactaga

SEQ ID NO: 15490 - DNA, 32 bp, Homo sapiens
cccttgttgcccaggctggagtgcaatggcgc

SEQ ID NO: 15491 - DNA, 32 bp, Homo sapiens
ctcttgttgtccaggctggagtgcaatggcgc

SEQ ID NO: 15492 - DNA, 32 bp, Homo sapiens
tgggaaagcccaacctggttctttaacaaggc

SEQ ID NO: 15493 - DNA, 32 bp, Homo sapiens
acaaagaggcctgggatattaggactttgggg

SEQ ID NO: 15494 - DNA, 32 bp, Homo sapiens
agcctcctgagtagctggaaccacaggcatgt

SEQ ID NO: 15495 - DNA, 22 bp, Homo sapiens
tcgtgaggtgagcgtgatccta

SEQ ID NO: 15496 - DNA, 32 bp, Homo sapiens
ccaagcggaggaggagaaaaaggaataagaag

SEQ ID NO: 15497 - DNA, 32 bp, Homo sapiens
tgggtgagaagagggaaaattgcagggacctc

SEQ ID NO: 15498 - DNA, 32 bp, Homo sapiens
catccctctgcagcctgtcatccctgtctgtg

SEQ ID NO: 15499 - DNA, 32 bp, Homo sapiens
ccaccctgtcttctcccctaggtggttcctga

SEQ ID NO: 15500 - DNA, 32 bp, Homo sapiens
aggaggagaggctgtctcagctgcagaggggt

SEQ ID NO: 15501 - DNA, 32 bp, Homo sapiens
catttgaggatccttcctatctctccatggga

SEQ ID NO: 15502 - DNA, 32 bp, Homo sapiens
aagatataatttcttgaaaatcttatcagaag

SEQ ID NO: 15503 - DNA, 23 bp, Homo sapiens
tggcaccgtcttggctcactgca

SEQ ID NO: 15504 - DNA, 32 bp, Homo sapiens
cagttttgcccagatgtgctagaatggggctg

SEQ ID NO: 15505 - DNA, 32 bp, Homo sapiens
gatccttcagttctggccattccagggaccct

SEQ ID NO: 15506 - DNA, 32 bp, Homo sapiens
tgctctcggaaccctggcgtctctccaccagc

SEQ ID NO: 15507 - DNA, 32 bp, Homo sapiens
atcagtaactgcattattgaattgttcttaaa

SEQ ID NO: 15508 - DNA, 32 bp, Homo sapiens
ctgtcctcaggtaatccgcccacctcagcctc

SEQ ID NO: 15509 - DNA, 32 bp, Homo sapiens
gtctcgaactcctggactcaagcaatccgccc

SEQ ID NO: 15510 - DNA, 32 bp, Homo sapiens
ccgttgaatgcaagctctcttctgccttctca

SEQ ID NO: 15511 - DNA, 32 bp, Homo sapiens
tgaagggaacatcttaccatctggccattcac

SEQ ID NO: 15512 - DNA, 32 bp, Homo sapiens
aggaggacaagaggagcatgaaagtggacaag

SEQ ID NO: 15513 - DNA, 32 bp, Homo sapiens
ctctgtcattcaggctggagtgcagtggtgca

SEQ ID NO: 15514 - DNA, 32 bp, Homo sapiens
ctcaggactagaggagaaggtcagagcaaagc

SEQ ID NO: 15515 - DNA, 26 bp, Homo sapiens
tggcacaagattatgactcactgtag

SEQ ID NO: 15516 - DNA, 32 bp, Homo sapiens
cgaggtgggaggcatgggaaacagtgcagtga

SEQ ID NO: 15517 - DNA, 32 bp, Homo sapiens
cggcactgggccacctgcccctgctggagggg

SEQ ID NO: 15518 - DNA, 32 bp, Homo sapiens
catttcacctgtcccgcagacaacagcaccat

SEQ ID NO: 15519 - DNA, 32 bp, Homo sapiens
tctactagtcgctggccccagtgcagtacccc

SEQ ID NO: 15520 - DNA, 32 bp, Homo sapiens
gaacccaggagacggtggttgcagtgagccaa

SEQ ID NO: 15521 - DNA, 32 bp, Homo sapiens
ccgggagggaggcaaatgagcattgagaaatt

SEQ ID NO: 15522 - DNA, 32 bp, Homo sapiens
cataagagagagaccgaattctgtggctcagc

SEQ ID NO: 15523 - DNA, 32 bp, Homo sapiens
gctctgtcgcccaggctggaatgcagtggtgc

SEQ ID NO: 15524 - DNA, 32 bp, Homo sapiens
gctctgttgcccgggctggagtgcagtggtgt

SEQ ID NO: 15525 - DNA, 32 bp, Homo sapiens
gctctgtcgcccaggctggagtgcagtgatgc

SEQ ID NO: 15526 - DNA, 32 bp, Homo sapiens
ctgggctcaagtgattctcccaccttgacctc

SEQ ID NO: 15527 - DNA, 32 bp, Homo sapiens
tgggaggctgaggcaggagaattctttgaacc

SEQ ID NO: 15528 - DNA, 22 bp, Homo sapiens
aactctaccacctgggctggaa

SEQ ID NO: 15529 - DNA, 32 bp, Homo sapiens
attgcggctttctgtctctggtgtgaacaggc

SEQ ID NO: 15530 - DNA, 32 bp, Homo sapiens
ccaaagtcacccagctgaacagtggtagagtt

SEQ ID NO: 15531 - DNA, 32 bp, Homo sapiens
ctcagtcgcccaggctggagtgcagtggcatg

SEQ ID NO: 15532 - DNA, 32 bp, Homo sapiens
tcggccgggctgctgctgctgctgctccaggt

SEQ ID NO: 15533 - DNA, 32 bp, Homo sapiens
atgctctcaccctcgtctggaggggcaggagt

SEQ ID NO: 15534 - DNA, 24 bp, Homo sapiens
tcacgcctataatctcagcacttt

SEQ ID NO: 15535 - DNA, 32 bp, Homo sapiens
ccaggttcaagcaattatcctgcctcagccac

SEQ ID NO: 15536 - DNA, 32 bp, Homo sapiens
accttacagaccattatggcatttgctagact

SEQ ID NO: 15537 - DNA, 32 bp, Homo sapiens
gggaactggctttgagatgacagggtccagga

SEQ ID NO: 15538 - DNA, 32 bp, Homo sapiens
actggcatcgcagcttcctgtctgtttatata

SEQ ID NO: 15539 - DNA, 24 bp, Homo sapiens
tcacgcttataatcccagcacttt

SEQ ID NO: 15540 - DNA, 32 bp, Homo sapiens
ctctgttgccctggctggagttcagtgacatg

SEQ ID NO: 15541 - DNA, 32 bp, Homo sapiens
ggaggaggaggaggagaaggaggaggaggaag

SEQ ID NO: 15542 - DNA, 32 bp, Homo sapiens
ccgggagccctctcttctccgcagaggagagc

SEQ ID NO: 15543 - DNA, 32 bp, Homo sapiens
tcctgggtgctgcagatactgcagtgaagtaa

SEQ ID NO: 15544 - DNA, 32 bp, Homo sapiens
acctccgctccctgggttcaagcgattctcct

SEQ ID NO: 15545 - DNA, 28 bp, Homo sapiens
agggtcccaagtggtacatcgtcatagc

SEQ ID NO: 15546 - DNA, 32 bp, Homo sapiens
catggagcctccagtctagctgcctcttgtgc

SEQ ID NO: 15547 - DNA, 32 bp, Homo sapiens
gctctgttgcccaggctggagtgcagtagcac

SEQ ID NO: 15548 - DNA, 32 bp, Homo sapiens
gaatccaggtggcggaggttgcagtgagccga

SEQ ID NO: 15549 - DNA, 25 bp, Homo sapiens
ggtgctgggagactgagcctgtggg

SEQ ID NO: 15550 - DNA, 32 bp, Homo sapiens
ctgagctcaagcaatcctgctgcctcagttct

SEQ ID NO: 15551 - DNA, 32 bp, Homo sapiens
tcactgccaacaacaacgaggttcctataatt

SEQ ID NO: 15552 - DNA, 32 bp, Homo sapiens
aaaggtgcctgagatgaaacttcctgagatga

SEQ ID NO: 15553 - DNA, 19 bp, Homo sapiens
gtgggaaagaggaggggga

SEQ ID NO: 15554 - DNA, 32 bp, Homo sapiens
tgttgcctgtgtagagcaagttacggtggtac

SEQ ID NO: 15555 - DNA, 23 bp, Homo sapiens
tggcgtaatcttggctcactgca

SEQ ID NO: 15556 - DNA, 32 bp, Homo sapiens
ccgcttgtgctgctgccatgtctctagtgatc

SEQ ID NO: 15557 - DNA, 32 bp, Homo sapiens
acagccatcccctatagaaaggcacagctttt

SEQ ID NO: 15558 - DNA, 32 bp, Homo sapiens
cacacaccgccagtgtcataccaaagagctga

SEQ ID NO: 15559 - DNA, 32 bp, Homo sapiens
ttggggcggagtttcactcttgttgcccaggc

SEQ ID NO: 15560 - DNA, 32 bp, Homo sapiens
gtccccgggccagcagggatggggttggggag

SEQ ID NO: 15561 - DNA, 32 bp, Homo sapiens
cagcctcataagggctggagtgctgtggtgcc

SEQ ID NO: 15562 - DNA, 32 bp, Homo sapiens
aaagaaatgtgaagagaaagaagataattttt

SEQ ID NO: 15563 - DNA, 32 bp, Homo sapiens
atgagtgggaggggagaaagcacacagagctc

SEQ ID NO: 15564 - DNA, 32 bp, Homo sapiens
ctactcgggaggctgaagcaggagaatggcgt

SEQ ID NO: 15565 - DNA, 24 bp, Homo sapiens
tcacgcatgtaatcctaacacttt

SEQ ID NO: 15566 - DNA, 32 bp, Homo sapiens
gtaacagcagaaaaggaaagaaacaaagaaca

SEQ ID NO: 15567 - DNA, 32 bp, Homo sapiens
ctgtcatcaagcaattcactgcatccctctgt

SEQ ID NO: 15568 - DNA, 32 bp, Homo sapiens
agtgaggtgggctcctggaactgcagcagcca

SEQ ID NO: 15569 - DNA, 32 bp, Homo sapiens
gggattgggctctcctgggccatggcagccga

SEQ ID NO: 15570 - DNA, 32 bp, Homo sapiens
ctctcatagtcttaatgcgtctggaccactgg

SEQ ID NO: 15571 - DNA, 32 bp, Homo sapiens
ctaccccaggaggctcttatctccccagcccc

SEQ ID NO: 15572 - DNA, 32 bp, Homo sapiens
actggttctgcagcttgtccttttgcccacat

SEQ ID NO: 15573 - DNA, 32 bp, Homo sapiens
cctctgaccccagcttctctctgattcccaca

SEQ ID NO: 15574 - DNA, 32 bp, Homo sapiens
tcttgttgcccaggctggagtgcaatggcaca

SEQ ID NO: 15575 - DNA, 32 bp, Homo sapiens
tcttgttacccaggctggagtgcaatggcacg

SEQ ID NO: 15576 - DNA, 32 bp, Homo sapiens
actctgttgccaggctggagtgcagtggcgca

SEQ ID NO: 15577 - DNA, 32 bp, Homo sapiens
acccagccaagtgccttttcctcagcactgag

SEQ ID NO: 15578 - DNA, 32 bp, Homo sapiens
agcggcgggccgcagaggttcaagcgattctc

SEQ ID NO: 15579 - DNA, 32 bp, Homo sapiens
cactttgtgcccctatctgcccatgaaaacag

SEQ ID NO: 15580 - DNA, 32 bp, Homo sapiens
ccgggttcaaactattctcccgcctcaacctc

SEQ ID NO: 15581 - DNA, 32 bp, Homo sapiens
caccctgttgccaggctggaatgcagtggcgc

SEQ ID NO: 15582 - DNA, 32 bp, Homo sapiens
agggactgcccaggactgagtccatatggaag

SEQ ID NO: 15583 - DNA, 32 bp, Homo sapiens
agcttttctgaaggagctttcctggcagggac

SEQ ID NO: 15584 - DNA, 32 bp, Homo sapiens
ctctgaggaagaggagcgaggacaacgttggc

SEQ ID NO: 15585 - DNA, 32 bp, Homo sapiens
ctgggttcacgccattctcccacctcagcttc

SEQ ID NO: 15586 - DNA, 32 bp, Homo sapiens
ggggtcgggggaggagaaagggagacagcaga

SEQ ID NO: 15587 - DNA, 32 bp, Homo sapiens
ccttttgtgttcctgctcacttcaagcttctt

SEQ ID NO: 15588 - DNA, 32 bp, Homo sapiens
ggggatctataatcttgtaacagggtctatct

SEQ ID NO: 15589 - DNA, 32 bp, Homo sapiens
gctctgttgccaggctggagtgcactggggct

SEQ ID NO: 15590 - DNA, 32 bp, Homo sapiens
cggtcttgcccagaggatcacagtgctgagac

SEQ ID NO: 15591 - DNA, 32 bp, Homo sapiens
ttctgtcgcccaggctggcgtgcagtggcgcg

SEQ ID NO: 15592 - DNA, 32 bp, Homo sapiens
gaacccaggaggcagaggttacagtgagcaga

SEQ ID NO: 15593 - DNA, 32 bp, Homo sapiens
gaatccaggaggcagagcttgcagtgagctga

SEQ ID NO: 15594 - DNA, 32 bp, Homo sapiens
tgccctgggaggcagtgatgggttagtggatg

SEQ ID NO: 15595 - DNA, 32 bp, Homo sapiens
atagaatctaagagttgattgtggaaaacacg

SEQ ID NO: 15596 - DNA, 32 bp, Homo sapiens
gctctgtcacccaggctggagttcagtggtgc

SEQ ID NO: 15597 - DNA, 32 bp, Homo sapiens
gggggagggaggcagtggtggctggagggtgc

SEQ ID NO: 15598 - DNA, 32 bp, Homo sapiens
tgtcttcctcaagcagtttaggtgcatgatct

SEQ ID NO: 15599 - DNA, 31 bp, Homo sapiens
gggaggagcatcatgagtaggagggaggcag

SEQ ID NO: 15600 - DNA, 32 bp, Homo sapiens
ccaggcttaaacgattctcccacctcagcctc

SEQ ID NO: 15601 - DNA, 32 bp, Homo sapiens
cgggacctgctgctgctccagccatgtccatg

SEQ ID NO: 15602 - DNA, 32 bp, Homo sapiens
tggagtccagtctcttctgctggcagaaagca

SEQ ID NO: 15603 - DNA, 32 bp, Homo sapiens
ttgtggcagtctgaacgcccccagaaaattgt

SEQ ID NO: 15604 - DNA, 32 bp, Homo sapiens
ccgcctcaccccggctggagtcatgtgggccg

SEQ ID NO: 15605 - DNA, 32 bp, Homo sapiens
aagcagagtcagcttgatttcaaggactctat

SEQ ID NO: 15606 - DNA, 32 bp, Homo sapiens
gactttgcagaaccggtccaaggtgagagtag

SEQ ID NO: 15607 - DNA, 32 bp, Homo sapiens
acctccgcctcttgggttcaagcgattcttct

SEQ ID NO: 15608 - DNA, 32 bp, Homo sapiens
agcggggagcccaggcggagcccagtcgactc

SEQ ID NO: 15609 - DNA, 32 bp, Homo sapiens
gaaccctggaggcggaggttgcagtgagccga

SEQ ID NO: 15610 - DNA, 32 bp, Homo sapiens
acctctgcctcctgggttcaagcgattttcct

SEQ ID NO: 15611 - DNA, 24 bp, Homo sapiens
tcacgcctgtaatcacagcacttt

SEQ ID NO: 15612 - DNA, 32 bp, Homo sapiens
gcctcgatttaaagagacagaagctgtcgggg

SEQ ID NO: 15613 - DNA, 32 bp, Homo sapiens
tctttccgtgtaagctatcccacctcagcggc

SEQ ID NO: 15614 - DNA, 32 bp, Homo sapiens
gctctgttgccaggctggagtgcagtggtgcg

SEQ ID NO: 15615 - DNA, 20 bp, Homo sapiens
gcccctgcacatgccaggtg

SEQ ID NO: 15616 - DNA, 24 bp, Homo sapiens
tcacgcatgtaatcccagcacttt

SEQ ID NO: 15617 - DNA, 32 bp, Homo sapiens
ggccaggcgggtgcccttggacagcttggaag

SEQ ID NO: 15618 - DNA, 32 bp, Homo sapiens
caggagccaagtgcttttggatggtgagggtg

SEQ ID NO: 15619 - DNA, 32 bp, Homo sapiens
gtgttcgcatcaacttggaagtgcagtaattg

SEQ ID NO: 15620 - DNA, 32 bp, Homo sapiens
gcggcggctgcggcttctctgggcgcctgggc

SEQ ID NO: 15621 - DNA, 32 bp, Homo sapiens
aacaagtttgtcaatccatctgaacttcagtt

SEQ ID NO: 15622 - DNA, 28 bp, Homo sapiens
ctagggctcagaggggcctcatcttccc

SEQ ID NO: 15623 - DNA, 32 bp, Homo sapiens
ctgacctggctgctgctcttgcttcagagcca

SEQ ID NO: 15624 - DNA, 32 bp, Homo sapiens
cgtctgctgctgctgcaggaggctccacttcg

SEQ ID NO: 15625 - DNA, 32 bp, Homo sapiens
ccagccgccagtcatggacacagggcactgcc

SEQ ID NO: 15626 - DNA, 32 bp, Homo sapiens
aagctgcgtccgggctggagcactggaacccg

SEQ ID NO: 15627 - DNA, 32 bp, Homo sapiens
tcgagatggagttttgctcttgttgcccaggc

SEQ ID NO: 15628 - DNA, 32 bp, Homo sapiens
agaaaacagccagcaggaggagcttcatctgt

SEQ ID NO: 15629 - DNA, 32 bp, Homo sapiens
agaaacccaacaattgggagattgagctggga

SEQ ID NO: 15630 - DNA, 32 bp, Homo sapiens
agtctgtttcccaggctggagtgtagtgatac

SEQ ID NO: 15631 - DNA, 32 bp, Homo sapiens
ggacctgggaggcagaggtttcagtgagccca

SEQ ID NO: 15632 - DNA, 32 bp, Homo sapiens
tggatatttacagcttcttttgtttttaattg

SEQ ID NO: 15633 - DNA, 32 bp, Homo sapiens
ctcatggtggtctcctgggcttggtcactgtc

SEQ ID NO: 15634 - DNA, 32 bp, Homo sapiens
ggggatgaggtgggagaaagcaaccacaacgt

SEQ ID NO: 15635 - DNA, 32 bp, Homo sapiens
gaaggaagggacagagaaagaagggacagagg

SEQ ID NO: 15636 - DNA, 32 bp, Homo sapiens
ataatggatactttgcttggatccaagtcaaa

SEQ ID NO: 15637 - DNA, 32 bp, Homo sapiens
tacagcaggacagaatatgaccaccttcgttt

SEQ ID NO: 15638 - DNA, 32 bp, Homo sapiens
tggcgggggaggcaggggtgagaggatggaat

SEQ ID NO: 15639 - DNA, 28 bp, Homo sapiens
gccatgatcaagcgtttcctggaggaca

SEQ ID NO: 15640 - DNA, 32 bp, Homo sapiens
tggcgtgggatgggggaaagaaaagaaagaga

SEQ ID NO: 15641 - DNA, 32 bp, Homo sapiens
agcctcccaagtagctgggaccacaggcatgc

SEQ ID NO: 15642 - DNA, 32 bp, Homo sapiens
cccttttcgcccaggctgagtacagtggtgca

SEQ ID NO: 15643 - DNA, 25 bp, Homo sapiens
ctgcagtccaagctgaacatgggaa

SEQ ID NO: 15644 - DNA, 19 bp, Homo sapiens
ggaacgcagagcaccgagg

SEQ ID NO: 15645 - DNA, 32 bp, Homo sapiens
ccctctccaaggctgagacacagggcatggcc

SEQ ID NO: 15646 - DNA, 32 bp, Homo sapiens
ttaaacctgcttgcttcctaccacagattctt

SEQ ID NO: 15647 - DNA, 23 bp, Homo sapiens
tggcacgatcctggctcactgca

SEQ ID NO: 15648 - DNA, 32 bp, Homo sapiens
gctctccatggcccacagcaggcacaggtctg

SEQ ID NO: 15649 - DNA, 32 bp, Homo sapiens
cccttgttgcccaggctggagtgcaatggcgt

SEQ ID NO: 15650 - DNA, 28 bp, Homo sapiens
aaatgccaaaaatgtgcctcattaagag

SEQ ID NO: 15651 - DNA, 32 bp, Homo sapiens
ttaaacccaagtgctgcacaaaagcagatact

SEQ ID NO: 15652 - DNA, 32 bp, Homo sapiens
ctgggttcaagggatcctcccacctcagcctc

SEQ ID NO: 15653 - DNA, 32 bp, Homo sapiens
cagggggttcacaattctcagcttcatctgag

SEQ ID NO: 15654 - DNA, 32 bp, Homo sapiens
ggcctgccaaagtgctgggattacaggcttga

SEQ ID NO: 15655 - DNA, 32 bp, Homo sapiens
taattaagtgtaatatggattactttgaaact

SEQ ID NO: 15656 - DNA, 19 bp, Homo sapiens
gcccacctcctccatgcct

SEQ ID NO: 15657 - DNA, 32 bp, Homo sapiens
ggtgccagccttctccccagtgagaacagttt

SEQ ID NO: 15658 - DNA, 32 bp, Homo sapiens
cagacttggtgcctgagcgcagctccagggaa

SEQ ID NO: 15659 - DNA, 32 bp, Homo sapiens
ttaagacattctaagtcacaggatgagacagg

SEQ ID NO: 15660 - DNA, 32 bp, Homo sapiens
tgattagcctgaggaccttcctgaggaggaat

SEQ ID NO: 15661 - DNA, 32 bp, Homo sapiens
tcttgtaccccaggctggagtgcaatggcgtg

SEQ ID NO: 15662 - DNA, 32 bp, Homo sapiens
tttagggatactttgttctcaccactgtccct

SEQ ID NO: 15663 - DNA, 32 bp, Homo sapiens
aactctttgctgctgcccatgtttcaaatact

SEQ ID NO: 15664 - DNA, 28 bp, Homo sapiens
cctggccccagtgctgcgtccttatcag

SEQ ID NO: 15665 - DNA, 32 bp, Homo sapiens
taactgaaagagaatcggtgctaagagctttt

SEQ ID NO: 15666 - DNA, 32 bp, Homo sapiens
tggacatcaagtgccttgcatagagccccctc

SEQ ID NO: 15667 - DNA, 32 bp, Homo sapiens
gtcttgaactcctgggctcaagcaatcctccc

SEQ ID NO: 15668 - DNA, 24 bp, Homo sapiens
tgacatgatcatagctcactgcag

SEQ ID NO: 15669 - DNA, 32 bp, Homo sapiens
cttccccttccctatacacacagggctcgaag

SEQ ID NO: 15670 - DNA, 32 bp, Homo sapiens
tctccgtctcccaggccagagtgcagtggcgc

SEQ ID NO: 15671 - DNA, 27 bp, Homo sapiens
ctctgtcgcccaggctggagtgcagtg

SEQ ID NO: 15672 - DNA, 32 bp, Homo sapiens
gtccaagatgtgcttgaaaatactcattaggt

SEQ ID NO: 15673 - DNA, 32 bp, Homo sapiens
tagcagtcacaccctagccactgctgggacct

SEQ ID NO: 15674 - DNA, 32 bp, Homo sapiens
gtcttgaactcctggcctcaagcaatccttcc

SEQ ID NO: 15675 - DNA, 32 bp, Homo sapiens
gaacccgggaggtggagcttgcagtgagccga

SEQ ID NO: 15676 - DNA, 32 bp, Homo sapiens
ctgcaggaaggccagaggttctggtggagttg

SEQ ID NO: 15677 - DNA, 32 bp, Homo sapiens
gaacctgggaggtggagcttgcagtgagctga

SEQ ID NO: 15678 - DNA, 32 bp, Homo sapiens
ctgttgtcacccaggctggagtgcagtggtgt

SEQ ID NO: 15679 - DNA, 32 bp, Homo sapiens
gctctgtcgcccaggctggagtgcagtggcgg

SEQ ID NO: 15680 - DNA, 32 bp, Homo sapiens
gctctgtggcccaggctggagtgtagtggcgt

SEQ ID NO: 15681 - DNA, 32 bp, Homo sapiens
agcctcccgagtagctgggattgcaggtgccc

SEQ ID NO: 15682 - DNA, 32 bp, Homo sapiens
caagtcaagaattgaggtttgggaacctccac

SEQ ID NO: 15683 - DNA, 32 bp, Homo sapiens
aggggtaccaaaacaggaagcctcactaggaa

SEQ ID NO: 15684 - DNA, 32 bp, Homo sapiens
tgaggccatagcaattcccctacatcaaatgc

SEQ ID NO: 15685 - DNA, 32 bp, Homo sapiens
agcctcctgagtagctgggagtacaggcgtgc

SEQ ID NO: 15686 - DNA, 32 bp, Homo sapiens
agcctcctgagtagctgggactataggcctgt

SEQ ID NO: 15687 - DNA, 32 bp, Homo sapiens
tgtaagcagcctctccccatctacctagcaac

SEQ ID NO: 15688 - DNA, 18 bp, Homo sapiens
gcccctcatctccaggtg

SEQ ID NO: 15689 - DNA, 24 bp, Homo sapiens
tcatgcctgtaatgccagcacttt

SEQ ID NO: 15690 - DNA, 20 bp, Homo sapiens
ctgctgttaaagttgcaggt

SEQ ID NO: 15691 - DNA, 32 bp, Homo sapiens
tgcaatgttcaatgccacgtgctgctgacacc

SEQ ID NO: 15692 - DNA, 32 bp, Homo sapiens
gacctcttcactgcttctctccccttcgagaa

SEQ ID NO: 15693 - DNA, 32 bp, Homo sapiens
acctctgcctcccgggttcaagcaatttcctg

SEQ ID NO: 15694 - DNA, 32 bp, Homo sapiens
acctccgcctcccaggttcaagtaattctgcc

SEQ ID NO: 15695 - DNA, 28 bp, Homo sapiens
atggaagctgaggctgcctcttcctagc

SEQ ID NO: 15696 - DNA, 32 bp, Homo sapiens
gcctggattgcaacatcctcccagagaaggaa

SEQ ID NO: 15697 - DNA, 32 bp, Homo sapiens
caatctggaaggcagaggttgcagtgagattg

SEQ ID NO: 15698 - DNA, 32 bp, Homo sapiens
taactatgactttggtcttaagcaattttctt

SEQ ID NO: 15699 - DNA, 32 bp, Homo sapiens
tggtaggtgatctcaggaattgcaggggaaag

SEQ ID NO: 15700 - DNA, 21 bp, Homo sapiens
tcatgcctgtaatctcagtac

SEQ ID NO: 15701 - DNA, 32 bp, Homo sapiens
cctgatctgccctgcactgagcactcagtgga

SEQ ID NO: 15702 - DNA, 21 bp, Homo sapiens
agagaggcccgcctgcccacc

SEQ ID NO: 15703 - DNA, 32 bp, Homo sapiens
taaaattcctgctctgccacagctccactcag

SEQ ID NO: 15704 - DNA, 32 bp, Homo sapiens
aaaagtgtcaccttttcttgcctgatcaacaa

SEQ ID NO: 15705 - DNA, 32 bp, Homo sapiens
acctccacctcccgggttcaagcagttctcct

SEQ ID NO: 15706 - DNA, 32 bp, Homo sapiens
actctgccacccagactgaagtgcagtggtgc

SEQ ID NO: 15707 - DNA, 32 bp, Homo sapiens
attgaacttgaagcatcggattacatgtttgt

SEQ ID NO: 15708 - DNA, 32 bp, Homo sapiens
ggctgagggaattgtcctctgtggaagggact

SEQ ID NO: 15709 - DNA, 32 bp, Homo sapiens
gggttcttggccaggctgtaggtggtggctca

SEQ ID NO: 15710 - DNA, 32 bp, Homo sapiens
caatcagatgcagctttctccttcgtctggtc

SEQ ID NO: 15711 - DNA, 32 bp, Homo sapiens
atcttgtattggagattgaaagatgctgtaat

SEQ ID NO: 15712 - DNA, 32 bp, Homo sapiens
cttggttgtaggtcaactcaatttttggtaga

SEQ ID NO: 15713 - DNA, 32 bp, Homo sapiens
agataaagtcttgggctgggtgcagtggctca

SEQ ID NO: 15714 - DNA, 32 bp, Homo sapiens
ggttctgggtcagcttcttttacctcaatttt

SEQ ID NO: 15715 - DNA, 32 bp, Homo sapiens
tgaagatctgcagctattcttttacttaacat

SEQ ID NO: 15716 - DNA, 32 bp, Homo sapiens
ggagctctggccactgcttcccatgagctgag

SEQ ID NO: 15717 - DNA, 32 bp, Homo sapiens
gctccagaaggagctttccaggatagctttga

SEQ ID NO: 15718 - DNA, 32 bp, Homo sapiens
agtttgagactatcctggtcaacatgatgaaa

SEQ ID NO: 15719 - DNA, 32 bp, Homo sapiens
cccgtggtgtggccagcctctttgccggacgc

SEQ ID NO: 15720 - DNA, 24 bp, Homo sapiens
ctgctgccttcctgctgtgaggtg

SEQ ID NO: 15721 - DNA, 32 bp, Homo sapiens
aagatggagccagcacagcactcattgcagtt

SEQ ID NO: 15722 - DNA, 32 bp, Homo sapiens
ccacacttgttgctgctcaacaggactgcact

SEQ ID NO: 15723 - DNA, 32 bp, Homo sapiens
gttctgtcacccaggctggcgtgcaatagttc

SEQ ID NO: 15724 - DNA, 32 bp, Homo sapiens
gtgggaggtaggcagagggcaggcaggagaaa

SEQ ID NO: 15725 - DNA, 32 bp, Homo sapiens
aagcttagtgcttgggttcagacagttgtggg

SEQ ID NO: 15726 - DNA, 28 bp, Homo sapiens
atgaacccaagtgaactttcctcattac

SEQ ID NO: 15727 - DNA, 27 bp, Homo sapiens
tcagaaggcaccagcaccagggcccag

SEQ ID NO: 15728 - DNA, 19 bp, Homo sapiens
cccctgccctgtccaggtg

SEQ ID NO: 15729 - DNA, 21 bp, Homo sapiens
caggacaaagagaaacctgag

SEQ ID NO: 15730 - DNA, 32 bp, Homo sapiens
gctctgtcaccaggctggagggcagtggcgcc

SEQ ID NO: 15731 - DNA, 32 bp, Homo sapiens
gagacaagaagagggaaagtagaaatattcta

SEQ ID NO: 15732 - DNA, 32 bp, Homo sapiens
acctctgtagctccaatgagtgacacatagta

SEQ ID NO: 15733 - DNA, 32 bp, Homo sapiens
atcgagatgcctatgaggagatcgtgaggctg

SEQ ID NO: 15734 - DNA, 32 bp, Homo sapiens
cctggttcaagcaattctcctgccttgcctcc

SEQ ID NO: 15735 - DNA, 32 bp, Homo sapiens
ccgggacgcgccgggctggagtgggcggttat

SEQ ID NO: 15736 - DNA, 32 bp, Homo sapiens
gtactgttgtccaggctggagcgcagttgatt

SEQ ID NO: 15737 - DNA, 22 bp, Homo sapiens
tgtggcctgggagagctgggga

SEQ ID NO: 15738 - DNA, 32 bp, Homo sapiens
tccagctttgtgtaattctctttgccagctgc

SEQ ID NO: 15739 - DNA, 32 bp, Homo sapiens
tttttaaatttcccagggaaggagaccgtcag

SEQ ID NO: 15740 - DNA, 32 bp, Homo sapiens
tctcttgtccaaggctggagtgtagtagtgct

SEQ ID NO: 15741 - DNA, 32 bp, Homo sapiens
agtctaagcccaaacaggaattcctgttgaat

SEQ ID NO: 15742 - DNA, 32 bp, Homo sapiens
gtacccaggaggcagagattgcagtgagctga

SEQ ID NO: 15743 - DNA, 32 bp, Homo sapiens
gctttgtcacccacgctggaatgcagtggcgg

SEQ ID NO: 15744 - DNA, 32 bp, Homo sapiens
tttagatggaatttcactcttgttgcccaggc

SEQ ID NO: 15745 - DNA, 21 bp, Homo sapiens
tccaggcccgagagaccagca

SEQ ID NO: 15746 - DNA, 32 bp, Homo sapiens
caggctcaacatcacatggaagctgccaatgc

SEQ ID NO: 15747 - DNA, 32 bp, Homo sapiens
gaacccaggaggcggagtttgcagtgagctga

SEQ ID NO: 15748 - DNA, 32 bp, Homo sapiens
cagggaaggaggcagctaggctgtagatggaa

SEQ ID NO: 15749 - DNA, 32 bp, Homo sapiens
gcgcgcacaggcaggaggttgcagttgggcgc

SEQ ID NO: 15750 - DNA, 32 bp, Homo sapiens
acgtgttctagagtgaagggggtgcgggtgtg

SEQ ID NO: 15751 - DNA, 32 bp, Homo sapiens
gcacctgggaggcaggcaggcatgcatgtggg

SEQ ID NO: 15752 - DNA, 32 bp, Homo sapiens
gaacccaggaggcagaggttgcagtaagccta

SEQ ID NO: 15753 - DNA, 22 bp, Homo sapiens
ggcacgatctcagctcactgca

SEQ ID NO: 15754 - DNA, 24 bp, Homo sapiens
tcacacctgtaatctcagcatttt

SEQ ID NO: 15755 - DNA, 32 bp, Homo sapiens
cctgtagaaagaggagtatggaacaaccttac

SEQ ID NO: 15756 - DNA, 32 bp, Homo sapiens
gcggcacccctcctgaagtaccacagatttag

SEQ ID NO: 15757 - DNA, 32 bp, Homo sapiens
taggtcagctcttttgaaaatgttttatttga

SEQ ID NO: 15758 - DNA, 32 bp, Homo sapiens
ggtgcaagcgaacttagtgactccttgaggtg

SEQ ID NO: 15759 - DNA, 32 bp, Homo sapiens
cctggttcaagcaattctgccccagcctccca

SEQ ID NO: 15760 - DNA, 32 bp, Homo sapiens
agcctcctgagtagctgggactagaggcgtgt

SEQ ID NO: 15761 - DNA, 32 bp, Homo sapiens
tttgtacaccttctgtttctttgcttattttt

SEQ ID NO: 15762 - DNA, 32 bp, Homo sapiens
ctactcgggaggctgaggcgggaggatcagtt

SEQ ID NO: 15763 - DNA, 32 bp, Homo sapiens
ttgcaccatcttctgcaggactgtattttgag

SEQ ID NO: 15764 - DNA, 32 bp, Homo sapiens
acagggcatcttctccagggcctcattcagtc

SEQ ID NO: 15765 - DNA, 23 bp, Homo sapiens
tcacgcctataatcccagcactt

SEQ ID NO: 15766 - DNA, 32 bp, Homo sapiens
ccctgccaagtttctgggcaccacagattgga

SEQ ID NO: 15767 - DNA, 32 bp, Homo sapiens
cttggcactcaagcagtccttctgcctcagcc

SEQ ID NO: 15768 - DNA, 32 bp, Homo sapiens
gaaacacatcttcagcctcctcctgggccagc

SEQ ID NO: 15769 - DNA, 24 bp, Homo sapiens
tcatgccagttatcccagcacttt

SEQ ID NO: 15770 - DNA, 28 bp, Homo sapiens
tccccacaagatgatgcctcatctccac

SEQ ID NO: 15771 - DNA, 28 bp, Homo sapiens
gacggggagagtgctgcttctatcgatg

SEQ ID NO: 15772 - DNA, 16 bp, Homo sapiens
gcctctgccacccaga

SEQ ID NO: 15773 - DNA, 32 bp, Homo sapiens
taacagaaactatcctgggattaggtgaaaaa

SEQ ID NO: 15774 - DNA, 32 bp, Homo sapiens
gagctcactgcagcttcaatctcctggctcaa

SEQ ID NO: 15775 - DNA, 32 bp, Homo sapiens
ctccgtcacccaggctggagtgcagtggcgcc

SEQ ID NO: 15776 - DNA, 32 bp, Homo sapiens
cacagggatacttggcttgggaaaactaaata

SEQ ID NO: 15777 - DNA, 32 bp, Homo sapiens
ggctcggtgctgctgctcgtcagcgaccccag

SEQ ID NO: 15778 - DNA, 32 bp, Homo sapiens
ggccttcccagtagctgggattacaggcacat

SEQ ID NO: 15779 - DNA, 32 bp, Homo sapiens
actctgtcacccaggctggagtgcagtagcac

SEQ ID NO: 15780 - DNA, 32 bp, Homo sapiens
tcttattgcccaggctggagtgcagtggcaca

SEQ ID NO: 15781 - DNA, 32 bp, Homo sapiens
gaacccaggaggtagaggctgcagtgagccgg

SEQ ID NO: 15782 - DNA, 32 bp, Homo sapiens
accactgcctcccaggttcaagcgattctcct

SEQ ID NO: 15783 - DNA, 28 bp, Homo sapiens
cctgcgtgctgccccgttcagtgtgccg

SEQ ID NO: 15784 - DNA, 21 bp, Homo sapiens
cagaacgggcagcccatcgtg

SEQ ID NO: 15785 - DNA, 32 bp, Homo sapiens
tgcctggctcttctccactggaccagggagct

SEQ ID NO: 15786 - DNA, 32 bp, Homo sapiens
gcaatcccccatgcccttaggagcaagcagtt

SEQ ID NO: 15787 - DNA, 32 bp, Homo sapiens
ctgtgtgcctccggaagacaccacctttccct

SEQ ID NO: 15788 - DNA, 32 bp, Homo sapiens
aagtcctcgctgccctctcttctcacctgcta

SEQ ID NO: 15789 - DNA, 32 bp, Homo sapiens
tttgccctctttccttctcttctcctcacagc

SEQ ID NO: 15790 - DNA, 22 bp, Homo sapiens
caacaccaacacctcctctcca

SEQ ID NO: 15791 - DNA, 25 bp, Homo sapiens
acaggcatgaaccaccacacctggc

SEQ ID NO: 15792 - DNA, 32 bp, Homo sapiens
cttcacctcagtggagcttctgagttttatac

SEQ ID NO: 15793 - DNA, 32 bp, Homo sapiens
ccgtggatgacggatgaggactctgggctgct

SEQ ID NO: 15794 - DNA, 32 bp, Homo sapiens
gaaggagggggaggagaagagagaagaaactg

SEQ ID NO: 15795 - DNA, 32 bp, Homo sapiens
acatgtgactgattaggaaatattttatggtc

SEQ ID NO: 15796 - DNA, 32 bp, Homo sapiens
tgggctgctccctcgtgcacagcgcaggggag

SEQ ID NO: 15797 - DNA, 22 bp, Homo sapiens
ccagaaagaccaccactttgca

SEQ ID NO: 15798 - DNA, 24 bp, Homo sapiens
gctttggtgagaaaactaatcttg

SEQ ID NO: 15799 - DNA, 32 bp, Homo sapiens
ttttaaaatcagcttgtcttgttccacaaact

SEQ ID NO: 15800 - DNA, 21 bp, Homo sapiens
ctgctggttgctgagcaagtg

SEQ ID NO: 15801 - DNA, 32 bp, Homo sapiens
ttaacccatccctcagcaaacgcagctcttcc

SEQ ID NO: 15802 - DNA, 32 bp, Homo sapiens
ccgggttcaagcagttctcctgcctcagcctc

SEQ ID NO: 15803 - DNA, 32 bp, Homo sapiens
atcccttctgagatcatctcccccaagaaagt

SEQ ID NO: 15804 - DNA, 32 bp, Homo sapiens
aacgtgcacatccaggagtcctttggacagtg

SEQ ID NO: 15805 - DNA, 32 bp, Homo sapiens
gtgctttagaagggagaaagcaaaaacatttt

SEQ ID NO: 15806 - DNA, 32 bp, Homo sapiens
attcttcctagagaagattatcctgtcctgca

SEQ ID NO: 15807 - DNA, 32 bp, Homo sapiens
agaggttgcagtgagctgagatcatgtcactg

SEQ ID NO: 15808 - DNA, 32 bp, Homo sapiens
agacttgtgctgcgtgcggctccggagctctg

SEQ ID NO: 15809 - DNA, 32 bp, Homo sapiens
gtctctgggttggctgttccagctccaaagag

SEQ ID NO: 15810 - DNA, 32 bp, Homo sapiens
gtgacggtctttattcccatctggcttctgca

SEQ ID NO: 15811 - DNA, 32 bp, Homo sapiens
ctaatccacatccttattgattagctacactg

SEQ ID NO: 15812 - DNA, 32 bp, Homo sapiens
agagctccagttctttataacaaaacagggat

SEQ ID NO: 15813 - DNA, 21 bp, Homo sapiens
gcgtgatctcggctcactgca

SEQ ID NO: 15814 - DNA, 18 bp, Homo sapiens
cccaggctggagtgcgat

SEQ ID NO: 15815 - DNA, 32 bp, Homo sapiens
atgaaattgggagttgctgtgtggaaactcaa

SEQ ID NO: 15816 - DNA, 32 bp, Homo sapiens
ctggggaggttagatgtgtgtttcaggcttgg

SEQ ID NO: 15817 - DNA, 32 bp, Homo sapiens
tctgtttcaggtgcccttggtgcagtataaat

SEQ ID NO: 15818 - DNA, 32 bp, Homo sapiens
gaacccaggaggcggaggttgcagtgatccaa

SEQ ID NO: 15819 - DNA, 32 bp, Homo sapiens
gacctcccttgccatgataaccaccttcgcag

SEQ ID NO: 15820 - DNA, 32 bp, Homo sapiens
gggccctctgcagcccagcctttccttccgtc

SEQ ID NO: 15821 - DNA, 32 bp, Homo sapiens
tagcaacatcttctccgagtcctgcagccagc

SEQ ID NO: 15822 - DNA, 32 bp, Homo sapiens
ccagaagacccaaaggagagtactggtttgtg

SEQ ID NO: 15823 - DNA, 32 bp, Homo sapiens
cagggcttcatccctgtgaaggcacagggcct

SEQ ID NO: 15824 - DNA, 32 bp, Homo sapiens
agtcatcctcaaggattttatcctggaacatt

SEQ ID NO: 15825 - DNA, 32 bp, Homo sapiens
ggccagtgcccaggttagtgagcagtgcccgg

SEQ ID NO: 15826 - DNA, 24 bp, Homo sapiens
ctggccaacatggtgaaacccgtc

SEQ ID NO: 15827 - DNA, 32 bp, Homo sapiens
gccactgtgcccagcctcacagctgcatctta

SEQ ID NO: 15828 - DNA, 32 bp, Homo sapiens
agcctcctgagtaactggggttacaggcgcgc

SEQ ID NO: 15829 - DNA, 32 bp, Homo sapiens
gctctgttgcctaggctggagtacagtggcct

SEQ ID NO: 15830 - DNA, 32 bp, Homo sapiens
aagagggggttagagagaaggcaggttgagac

SEQ ID NO: 15831 - DNA, 32 bp, Homo sapiens
ctggtctcaagcagtcctcccacctcagcctc

SEQ ID NO: 15832 - DNA, 32 bp, Homo sapiens
ctggcctcaagcaatcctcctgcctcagcctc

SEQ ID NO: 15833 - DNA, 32 bp, Homo sapiens
actcgagtccatgggacccccacgctcgtgag

SEQ ID NO: 15834 - DNA, 28 bp, Homo sapiens
ttcaggctaagagctgcctcgctctttg

SEQ ID NO: 15835 - DNA, 32 bp, Homo sapiens
cagaaagttgaggaagaaagaactcaagtaca

SEQ ID NO: 15836 - DNA, 32 bp, Homo sapiens
aatttttcttaggtgaggaggattattaactg

SEQ ID NO: 15837 - DNA, 32 bp, Homo sapiens
gagcccgggaggtcaaggttgcagtgagtcat

SEQ ID NO: 15838 - DNA, 32 bp, Homo sapiens
actctttatcttctcatcttactggcctggtc

SEQ ID NO: 15839 - DNA, 22 bp, Homo sapiens
tcacgcctggaatcccagcact

SEQ ID NO: 15840 - DNA, 21 bp, Homo sapiens
tcatgaggtgggatggcccca

SEQ ID NO: 15841 - DNA, 32 bp, Homo sapiens
agtagaggagcctcttctcatggccaccattg

SEQ ID NO: 15842 - DNA, 32 bp, Homo sapiens
gtcactctccacccttcccttctgcctgccca

SEQ ID NO: 15843 - DNA, 22 bp, Homo sapiens
tgcagggaggaggaaatggggg

SEQ ID NO: 15844 - DNA, 32 bp, Homo sapiens
ctatgttgcccaggctggttgcaaacttctgg

SEQ ID NO: 15845 - DNA, 32 bp, Homo sapiens
gggatgaggagaggagaacagagggatggtga

SEQ ID NO: 15846 - DNA, 32 bp, Homo sapiens
catcttgcagaacttctgctggagtcgaaatc

SEQ ID NO: 15847 - DNA, 32 bp, Homo sapiens
gctgtattgcccaggctggagtgcagtggcgc

SEQ ID NO: 15848 - DNA, 32 bp, Homo sapiens
caggggtcaggtgaggcttgagcttgaggagt

SEQ ID NO: 15849 - DNA, 32 bp, Homo sapiens
cactgttgcccaggctggactgcagtggcgtg

SEQ ID NO: 15850 - DNA, 32 bp, Homo sapiens
agccccctgagtagctgggattacaggtgcac

SEQ ID NO: 15851 - DNA, 32 bp, Homo sapiens
cttgaacctgtgagctgggatcgtgccactgc

SEQ ID NO: 15852 - DNA, 32 bp, Homo sapiens
ctctgttgcccaggctggaatgcagtggtacg

SEQ ID NO: 15853 - DNA, 32 bp, Homo sapiens
agcctcctgagtagctgggactataggtgcat

SEQ ID NO: 15854 - DNA, 32 bp, Homo sapiens
agcctcacaagtagctgggattacaggtgccc

SEQ ID NO: 15855 - DNA, 32 bp, Homo sapiens
agcctcccaagtagctgggattacaggtgcac

SEQ ID NO: 15856 - DNA, 32 bp, Homo sapiens
acttccttcagggattctccctaaattttagc

SEQ ID NO: 15857 - DNA, 32 bp, Homo sapiens
tccctgcctggatctcacgagcactttccctc

SEQ ID NO: 15858 - DNA, 24 bp, Homo sapiens
ctgtcgcccaagctggagcgcaat

SEQ ID NO: 15859 - DNA, 32 bp, Homo sapiens
ctgggctcaagcaatcctcccacttcagcctc

SEQ ID NO: 15860 - DNA, 32 bp, Homo sapiens
gaacccgggacgcaggggttgcagtgagcgga

SEQ ID NO: 15861 - DNA, 32 bp, Homo sapiens
acctccacctcccaggttcaagggattcgtct

SEQ ID NO: 15862 - DNA, 32 bp, Homo sapiens
ctgggctcaagcaattctcccacctcagcctc

SEQ ID NO: 15863 - DNA, 32 bp, Homo sapiens
ccctgagcctgagtcatttctatgtgaagtca

SEQ ID NO: 15864 - DNA, 32 bp, Homo sapiens
ttatttttgctgtcttctcttggcttattttt

SEQ ID NO: 15865 - DNA, 21 bp, Homo sapiens
tgtgacaaaacctttaagcca

SEQ ID NO: 15866 - DNA, 32 bp, Homo sapiens
ttgagatggagtctcgctcttgtcgcccaggc

SEQ ID NO: 15867 - DNA, 32 bp, Homo sapiens
tatgtgctgctgctgctcaagagctggatcca

SEQ ID NO: 15868 - DNA, 32 bp, Homo sapiens
tgttatcctttgtatttataggcacagttatc

SEQ ID NO: 15869 - DNA, 32 bp, Homo sapiens
tgggtgggtgcctggctgtgtgcagtgaggag

SEQ ID NO: 15870 - DNA, 32 bp, Homo sapiens
aaagggagaagagggaaaaggaagcacgtccc

SEQ ID NO: 15871 - DNA, 32 bp, Homo sapiens
tgatagggcaggaagagaagaaaacggaggag

SEQ ID NO: 15872 - DNA, 32 bp, Homo sapiens
ggctcttgcctgtaatcccagcactttgggga

SEQ ID NO: 15873 - DNA, 32 bp, Homo sapiens
ccaaggcactcagccttctagtgcagtagcat

SEQ ID NO: 15874 - DNA, 32 bp, Homo sapiens
ctctgttgcccacattggagtgcagtggcacg

SEQ ID NO: 15875 - DNA, 32 bp, Homo sapiens
ctactcgggaggctgaggcaggagagaatcgc

SEQ ID NO: 15876 - DNA, 32 bp, Homo sapiens
tgaggagcagcagagtctgatactaggtctag

SEQ ID NO: 15877 - DNA, 18 bp, Homo sapiens
aaggaactggcatgcaca

SEQ ID NO: 15878 - DNA, 24 bp, Homo sapiens
tcatgcctgtggtcccagcacttt

SEQ ID NO: 15879 - DNA, 32 bp, Homo sapiens
gggagagagaggagaaaggcgaaggagaagga

SEQ ID NO: 15880 - DNA, 24 bp, Homo sapiens
tggcacgatctcggctcactgcag

SEQ ID NO: 15881 - DNA, 18 bp, Homo sapiens
ggtggctgtgcaggtggc

SEQ ID NO: 15882 - DNA, 32 bp, Homo sapiens
cgggaccatcttctcggccatctcctgcttct

SEQ ID NO: 15883 - DNA, 32 bp, Homo sapiens
gccttgtgtcagagctgggagtagcatggact

SEQ ID NO: 15884 - DNA, 24 bp, Homo sapiens
tggcgcgatctcagctcactgcag

SEQ ID NO: 15885 - DNA, 24 bp, Homo sapiens
tggcgcgatctcggctcactacag

SEQ ID NO: 15886 - DNA, 28 bp, Homo sapiens
gaccaacccatggttgcctcatcagcag

SEQ ID NO: 15887 - DNA, 32 bp, Homo sapiens
taatttatgaattttacttgcaccttatagtt

SEQ ID NO: 15888 - DNA, 32 bp, Homo sapiens
ttgtttgggaggcatagtgctgacatatattc

SEQ ID NO: 15889 - DNA, 32 bp, Homo sapiens
agcagagggaggcagaagcgtggaggaagggg

SEQ ID NO: 15890 - DNA, 28 bp, Homo sapiens
cacctggccactgctgccttatccattc

SEQ ID NO: 15891 - DNA, 32 bp, Homo sapiens
aggctaccctgactaagccacagggttggcat

SEQ ID NO: 15892 - DNA, 32 bp, Homo sapiens
ggtgtctctgcagctggcctccggagccttcc

SEQ ID NO: 15893 - DNA, 32 bp, Homo sapiens
gagcccaggagttcagggctgcagtgagcctt

SEQ ID NO: 15894 - DNA, 32 bp, Homo sapiens
acacactcttgggctgacctttattttatcaa

SEQ ID NO: 15895 - DNA, 23 bp, Homo sapiens
tggcatgatgtcggctcactgca

SEQ ID NO: 15896 - DNA, 32 bp, Homo sapiens
atagtgcagcctcagccccaggcacagcgccg

SEQ ID NO: 15897 - DNA, 32 bp, Homo sapiens
ctcttgttgcccaggctggagtgcagtggtgt

SEQ ID NO: 15898 - DNA, 32 bp, Homo sapiens
ctcttgttgcccaggctggagtacagtggtat

SEQ ID NO: 15899 - DNA, 32 bp, Homo sapiens
ctctgtcacacaggctggagtgcagtacaatt

SEQ ID NO: 15900 - DNA, 32 bp, Homo sapiens
cctccaccttcctggttcaagggattctcctg

SEQ ID NO: 15901 - DNA, 32 bp, Homo sapiens
acctattggctattgtgaatggtgctgctatg

SEQ ID NO: 15902 - DNA, 32 bp, Homo sapiens
ccaggttcaagtgattctcccacctcagcctc

SEQ ID NO: 15903 - DNA, 32 bp, Homo sapiens
ttctctgggaggcaaaggctggcactggactg

SEQ ID NO: 15904 - DNA, 32 bp, Homo sapiens
gaccccaggtggtggaggttgcagtgagccaa

SEQ ID NO: 15905 - DNA, 32 bp, Homo sapiens
gcgcaggggaggcagaagtcatgacaggcgag

SEQ ID NO: 15906 - DNA, 16 bp, Homo sapiens
gcccctgcctcccagg

SEQ ID NO: 15907 - DNA, 32 bp, Homo sapiens
cagggtgggagcagggaaagaaaaggaaaata

SEQ ID NO: 15908 - DNA, 32 bp, Homo sapiens
ttctttgggggtggaaaaggaaaacaattcaa

SEQ ID NO: 15909 - DNA, 32 bp, Homo sapiens
tgagcacacaattatgcaaatattttaatgtt

SEQ ID NO: 15910 - DNA, 16 bp, Homo sapiens
agggactctccagcct

SEQ ID NO: 15911 - DNA, 32 bp, Homo sapiens
accacaaaccctgctgaacacagtgtctgttc

SEQ ID NO: 15912 - DNA, 32 bp, Homo sapiens
ttcagtgtctgtggctggagagtgtgtctttc

SEQ ID NO: 15913 - DNA, 32 bp, Homo sapiens
tcccatccagttctggagttcgtagagagtga

SEQ ID NO: 15914 - DNA, 32 bp, Homo sapiens
catgctgctgttggctccatctctccacactg

SEQ ID NO: 15915 - DNA, 32 bp, Homo sapiens
aagaatttgccatcagtagcagtattaagcag

SEQ ID NO: 15916 - DNA, 32 bp, Homo sapiens
agcctcctgagtagctgggattacagacgcac

SEQ ID NO: 15917 - DNA, 32 bp, Homo sapiens
gcccaggctggagtgcagtagtgcagtcgtgg

SEQ ID NO: 15918 - DNA, 32 bp, Homo sapiens
attactgtaaagaacttcctgtaaaacacgtt

SEQ ID NO: 15919 - DNA, 28 bp, Homo sapiens
cctcccaggaatgctgccttccttcagc

SEQ ID NO: 15920 - DNA, 32 bp, Homo sapiens
ctgggttcaagcaattctccttcttcagcctc

SEQ ID NO: 15921 - DNA, 32 bp, Homo sapiens
cgctgagcctgagacgggaggcaggaaagggg

SEQ ID NO: 15922 - DNA, 32 bp, Homo sapiens
gaacccaggaggcggaggttgcagggagggag

SEQ ID NO: 15923 - DNA, 32 bp, Homo sapiens
cttaagccacacacattgttgctgctatgact

SEQ ID NO: 15924 - DNA, 32 bp, Homo sapiens
actgctctacctgaatttagactaagcagtaa

SEQ ID NO: 15925 - DNA, 32 bp, Homo sapiens
gagtggaggagaggagacaaggctctggacag

SEQ ID NO: 15926 - DNA, 32 bp, Homo sapiens
ggtggagtcccagagctgcacagggtttggcc

SEQ ID NO: 15927 - DNA, 32 bp, Homo sapiens
agctcctgcctggattcccagcactttgggag

SEQ ID NO: 15928 - DNA, 23 bp, Homo sapiens
gttttggaagagctttttattta

SEQ ID NO: 15929 - DNA, 32 bp, Homo sapiens
ttcttttgcccaggctggagtgcagtggcaca

SEQ ID NO: 15930 - DNA, 32 bp, Homo sapiens
gctagacaagaagcgttcctggagctgcttta

SEQ ID NO: 15931 - DNA, 20 bp, Homo sapiens
caggagacaaaagagcagtg

SEQ ID NO: 15932 - DNA, 32 bp, Homo sapiens
ttagaatgagaattaaagagaaaacaaaagaa

SEQ ID NO: 15933 - DNA, 32 bp, Homo sapiens
gggccctggaggtcaaggctgcagtgagtcaa

SEQ ID NO: 15934 - DNA, 32 bp, Homo sapiens
ttgagatggagtttcactcttgtgcccaggct

SEQ ID NO: 15935 - DNA, 32 bp, Homo sapiens
ctgaatgcctgagactctagcagaaatggcct

SEQ ID NO: 15936 - DNA, 32 bp, Homo sapiens
ctgtctgcttcaggagcttcgtactggctaat

SEQ ID NO: 15937 - DNA, 32 bp, Homo sapiens
ctccgttgcccaggttggagtgcagtggccca

SEQ ID NO: 15938 - DNA, 32 bp, Homo sapiens
gctccactccttggctggaggcagtgctgagg

SEQ ID NO: 15939 - DNA, 32 bp, Homo sapiens
gttggcagccgcttgagccactgcgaggaaag

SEQ ID NO: 15940 - DNA, 32 bp, Homo sapiens
atagagatcccaacttgaaacaacagccagtg

SEQ ID NO: 15941 - DNA, 32 bp, Homo sapiens
agacccgggggcaggtgctgcagtgaggggtc

SEQ ID NO: 15942 - DNA, 32 bp, Homo sapiens
ccctccttgtccagactgggctacttgcagtt

SEQ ID NO: 15943 - DNA, 32 bp, Homo sapiens
gactctcatccctgggcacagaattcaggaaa

SEQ ID NO: 15944 - DNA, 32 bp, Homo sapiens
ctgttcctctgttcctctcttctcctgccccc

SEQ ID NO: 15945 - DNA, 32 bp, Homo sapiens
ggcaaaagaagaggaaggaatttaatcctaat

SEQ ID NO: 15946 - DNA, 32 bp, Homo sapiens
actctgttccccaggccggagtgcagtggtac

SEQ ID NO: 15947 - DNA, 32 bp, Homo sapiens
gctctgtcgcccagggtggagtgcagtggcgt

SEQ ID NO: 15948 - DNA, 32 bp, Homo sapiens
gagaatcgcttgagctggagtgcagtggtgca

SEQ ID NO: 15949 - DNA, 32 bp, Homo sapiens
ccgccatcccccgacccctctgatctccgatc

SEQ ID NO: 15950 - DNA, 32 bp, Homo sapiens
gatgtagcctccaggcacttctgctctctggc

SEQ ID NO: 15951 - DNA, 32 bp, Homo sapiens
gctctatcacccaggctgaagtgcagtagtgc

SEQ ID NO: 15952 - DNA, 32 bp, Homo sapiens
ataaagactagaaccacccccactctgcactc

SEQ ID NO: 15953 - DNA, 32 bp, Homo sapiens
ctgggaggagtgtttgcactgtggaaattggt

SEQ ID NO: 15954 - DNA, 32 bp, Homo sapiens
agacagggtcttgactggagtgcagtggtgcg

SEQ ID NO: 15955 - DNA, 28 bp, Homo sapiens
ccgtgcccaagtgagtccttaccgcctc

SEQ ID NO: 15956 - DNA, 32 bp, Homo sapiens
ccatcaagtggactggggcagtgcagtagcac

SEQ ID NO: 15957 - DNA, 32 bp, Homo sapiens
tgtgagaccatcatggtgccagtctaggaccc

SEQ ID NO: 15958 - DNA, 32 bp, Homo sapiens
taactgcatcttctctgacccctggtaccaga

SEQ ID NO: 15959 - DNA, 32 bp, Homo sapiens
aaaggaagtagttcagcatctatcgccagcca

SEQ ID NO: 15960 - DNA, 32 bp, Homo sapiens
ttggcctcaagcaatcctcctccagagcctcc

SEQ ID NO: 15961 - DNA, 32 bp, Homo sapiens
gctatgtcactcaggctggagtgcagtggcac

SEQ ID NO: 15962 - DNA, 32 bp, Homo sapiens
gtctgagttctctcttccttcccctgcataga

SEQ ID NO: 15963 - DNA, 32 bp, Homo sapiens
ctgggctcaagcaatcctcctgcctcagcttc

SEQ ID NO: 15964 - DNA, 32 bp, Homo sapiens
acctctgccttctgggttcgagcaattctcct

SEQ ID NO: 15965 - DNA, 32 bp, Homo sapiens
agaactataaattttgtttaagcaatttataa

SEQ ID NO: 15966 - DNA, 32 bp, Homo sapiens
ctgggtttaagcaattctcctgcctcagcctc

SEQ ID NO: 15967 - DNA, 17 bp, Homo sapiens
gccaatgccactcagaa

SEQ ID NO: 15968 - DNA, 32 bp, Homo sapiens
ctggacgggccttgtccttgccgaggaaaccc

SEQ ID NO: 15969 - DNA, 23 bp, Homo sapiens
atccaaatgtgtaccattggtga

SEQ ID NO: 15970 - DNA, 32 bp, Homo sapiens
cagagagatgttcttgtttctggtgttgtcac

SEQ ID NO: 15971 - DNA, 32 bp, Homo sapiens
actcttcactcaggctgcagtgcagtggcgca

SEQ ID NO: 15972 - DNA, 17 bp, Homo sapiens
cagggaagcagcagcct

SEQ ID NO: 15973 - DNA, 32 bp, Homo sapiens
ctgggttcaagcaatcctcctgcctcagcctc

SEQ ID NO: 15974 - DNA, 32 bp, Homo sapiens
tagaaactgagtagtttggatttttatggctc

SEQ ID NO: 15975 - DNA, 32 bp, Homo sapiens
tgttgttgcccaggctggagtgcagtggcgtg

SEQ ID NO: 15976 - DNA, 32 bp, Homo sapiens
gaaactggaaggcagaggttgcagtgagccaa

SEQ ID NO: 15977 - DNA, 32 bp, Homo sapiens
gaactcgggaggcgaaggttgcagtgagccga

SEQ ID NO: 15978 - DNA, 32 bp, Homo sapiens
gaacttgggaggcggaggttgcagtgagctaa

SEQ ID NO: 15979 - DNA, 32 bp, Homo sapiens
gaacccgggaggcggaggttgcagtgagtcaa

SEQ ID NO: 15980 - DNA, 32 bp, Homo sapiens
gaacctaggaggtggaggttgcagtgagctga

SEQ ID NO: 15981 - DNA, 32 bp, Homo sapiens
gaacctgggaggtggaggttgcggtgagctga

SEQ ID NO: 15982 - DNA, 32 bp, Homo sapiens
caccggccacttctcccccgtccatctgacca

SEQ ID NO: 15983 - DNA, 32 bp, Homo sapiens
gaacccgggaggtggaggttgcagtgagccaa

SEQ ID NO: 15984 - DNA, 32 bp, Homo sapiens
gaacccaggaggtggaggttgcagtgagccga

SEQ ID NO: 15985 - DNA, 32 bp, Homo sapiens
gggaggctgctgctgctcttggctggacccag

SEQ ID NO: 15986 - DNA, 32 bp, Homo sapiens
tcttcctacccatctgctccccagagggctgc

SEQ ID NO: 15987 - DNA, 32 bp, Homo sapiens
tctagatatcttctccaccctccttgcaccag

SEQ ID NO: 15988 - DNA, 32 bp, Homo sapiens
ttattgctggctcaaggaaaattctttgaaat

SEQ ID NO: 15989 - DNA, 32 bp, Homo sapiens
ccaggctgggctgtggcttcaagctttggaaa

SEQ ID NO: 15990 - DNA, 32 bp, Homo sapiens
gctgtgttgcccaggctggagtgcagtagcta

SEQ ID NO: 15991 - DNA, 32 bp, Homo sapiens
aggagacattgtctccccagttggttctgtcc

SEQ ID NO: 15992 - DNA, 32 bp, Homo sapiens
aaacctgggagacggaggttgcagtgagccaa

SEQ ID NO: 15993 - DNA, 32 bp, Homo sapiens
gaacccaggagacggaagttgcagtgagctga

SEQ ID NO: 15994 - DNA, 32 bp, Homo sapiens
ttgatttgcatatcctgggtgtactgagccac

SEQ ID NO: 15995 - DNA, 32 bp, Homo sapiens
agaaacaaactccagacgcaccaccttaagag

SEQ ID NO: 15996 - DNA, 21 bp, Homo sapiens
tgtggggagggaaaatgagga

SEQ ID NO: 15997 - DNA, 32 bp, Homo sapiens
ctaagtagcaggcagtgccactgtggacagtg

SEQ ID NO: 15998 - DNA, 32 bp, Homo sapiens
cttgtgtggctgctgcgcagccttcaacaaca

SEQ ID NO: 15999 - DNA, 32 bp, Homo sapiens
ctctctggggcctctttaaatagggtcaccaa

SEQ ID NO: 16000 - DNA, 32 bp, Homo sapiens
gatgctgcccctgggaaatcccagaagaggaa

SEQ ID NO: 16001 - DNA, 32 bp, Homo sapiens
tgctgtctccccggctggagcgcagtggcacg

SEQ ID NO: 16002 - DNA, 32 bp, Homo sapiens
gggtatgcaagcctaaatctttgtacactttg

SEQ ID NO: 16003 - DNA, 32 bp, Homo sapiens
tgtgctcaggaaacctcacccacctcagccct

SEQ ID NO: 16004 - DNA, 32 bp, Homo sapiens
tgggtttggttagaggaaggctgaactcttca

SEQ ID NO: 16005 - DNA, 32 bp, Homo sapiens
ctcttgtcacccacgctggagtgcaatggtgt

SEQ ID NO: 16006 - DNA, 32 bp, Homo sapiens
agaaaagctgggtcagcatctggccaccgagc

SEQ ID NO: 16007 - DNA, 24 bp, Homo sapiens
tcatgcctgtggtcccagaacttt

SEQ ID NO: 16008 - DNA, 32 bp, Homo sapiens
ctgaagtgcaggttgctcacagcatcctacaa

SEQ ID NO: 16009 - DNA, 32 bp, Homo sapiens
gaaagcattgttttagtccaggcacagtggct

SEQ ID NO: 16010 - DNA, 32 bp, Homo sapiens
tggccctatgatctatcctttacttgaaagct

SEQ ID NO: 16011 - DNA, 32 bp, Homo sapiens
atgaggtggagttttactcttgttgtctaggc

SEQ ID NO: 16012 - DNA, 21 bp, Homo sapiens
tggactgcgcggcgccgtgag

SEQ ID NO: 16013 - DNA, 32 bp, Homo sapiens
tttttagagccagtcaaatggtatttaagtta

SEQ ID NO: 16014 - DNA, 32 bp, Homo sapiens
gactgctgcccaggtggggtttcctgcatgga

SEQ ID NO: 16015 - DNA, 32 bp, Homo sapiens
ccctatctggcagtcctgctttgctacttgct

SEQ ID NO: 16016 - DNA, 32 bp, Homo sapiens
atgtgtagggttggggagagtgcagtgatggg

SEQ ID NO: 16017 - DNA, 32 bp, Homo sapiens
tcttcagcctccatccctggcctcctcccctc

SEQ ID NO: 16018 - DNA, 32 bp, Homo sapiens
acactgcaacaacaggagtgcaaacttctcta

SEQ ID NO: 16019 - DNA, 32 bp, Homo sapiens
ttgctgtctccccggctggagcgcagtggcac

SEQ ID NO: 16020 - DNA, 32 bp, Homo sapiens
ccaggttgaagcaattctcctgcctcagcctt

SEQ ID NO: 16021 - DNA, 32 bp, Homo sapiens
ataacaagtgacaaggcagaattctttaaatc

SEQ ID NO: 16022 - DNA, 32 bp, Homo sapiens
ctctgtcacccaggctgaagtgcagtggtaca

SEQ ID NO: 16023 - DNA, 24 bp, Homo sapiens
tcacgcctgtaatctcaacacttt

SEQ ID NO: 16024 - DNA, 32 bp, Homo sapiens
aaacctgagaggcagaggttacagtgagccaa

SEQ ID NO: 16025 - DNA, 20 bp, Homo sapiens
tgcggggagaagacggagga

SEQ ID NO: 16026 - DNA, 32 bp, Homo sapiens
ggccacacctctctccccagggcccggcagtg

SEQ ID NO: 16027 - DNA, 17 bp, Homo sapiens
gcctatgccaccaggta

SEQ ID NO: 16028 - DNA, 32 bp, Homo sapiens
ttgagacggagtttcactcttgttgcccaggc

SEQ ID NO: 16029 - DNA, 32 bp, Homo sapiens
ctgggactgtaaacatgacagccgcacttcac

SEQ ID NO: 16030 - DNA, 32 bp, Homo sapiens
cctctcctggcagcttctcaggtctccctaat

SEQ ID NO: 16031 - DNA, 32 bp, Homo sapiens
ctctgttgcccaggctgaagtgcagtggtgtg

SEQ ID NO: 16032 - DNA, 32 bp, Homo sapiens
ttgagacagagtttcgctcttgttgcccaggc

SEQ ID NO: 16033 - DNA, 32 bp, Homo sapiens
ttgagatggagtttcactcttgctgcccaggc

SEQ ID NO: 16034 - DNA, 32 bp, Homo sapiens
ccaggctcatgtgatcctcccacctcagcctc

SEQ ID NO: 16035 - DNA, 32 bp, Homo sapiens
agtctcccaaagggctgggattaaaggcatga

SEQ ID NO: 16036 - DNA, 32 bp, Homo sapiens
ctctgttgcccattctggagtgcagtggtgtg

SEQ ID NO: 16037 - DNA, 24 bp, Homo sapiens
tcacacctgtaattgcagcacttt

SEQ ID NO: 16038 - DNA, 32 bp, Homo sapiens
catgaccttgggcacatgagatcatgtcctcc

SEQ ID NO: 16039 - DNA, 32 bp, Homo sapiens
gagcctgggaagtggaggctgcagtgagccta

SEQ ID NO: 16040 - DNA, 32 bp, Homo sapiens
ctgttttggatgttttgtgtctctccagctac

SEQ ID NO: 16041 - DNA, 32 bp, Homo sapiens
cctcgggccctctctccgccccggacagggtg

SEQ ID NO: 16042 - DNA, 32 bp, Homo sapiens
aagttgtgggggcttttcaagaggggccaggc

SEQ ID NO: 16043 - DNA, 32 bp, Homo sapiens
ctctgttgcccaggctggagtgtaatggtgca

SEQ ID NO: 16044 - DNA, 32 bp, Homo sapiens
aagcagagggaatgtgaaagaaaataagagaa

SEQ ID NO: 16045 - DNA, 32 bp, Homo sapiens
tgggggagaggtacagaaagaagagaaaagac

SEQ ID NO: 16046 - DNA, 32 bp, Homo sapiens
ggcccatgcctgtaatcccagcactttgggag

SEQ ID NO: 16047 - DNA, 32 bp, Homo sapiens
cctctccccctccttccatctcttctctctct

SEQ ID NO: 16048 - DNA, 32 bp, Homo sapiens
ttctgccacccaggctggagtacagtggcatg

SEQ ID NO: 16049 - DNA, 28 bp, Homo sapiens
caaaattcagctgctgcctctgtcttga

SEQ ID NO: 16050 - DNA, 32 bp, Homo sapiens
gaaacttcaagcaaatctacttcaacacttca

SEQ ID NO: 16051 - DNA, 32 bp, Homo sapiens
ggataaaatttcctttggaaagaacccatgga

SEQ ID NO: 16052 - DNA, 24 bp, Homo sapiens
gatgaggaaactgaggcctggaga

SEQ ID NO: 16053 - DNA, 32 bp, Homo sapiens
tgagctcgctgagacttcctggaccccgcacc

SEQ ID NO: 16054 - DNA, 32 bp, Homo sapiens
acagaggttatctgtcccaggttatctgggca

SEQ ID NO: 16055 - DNA, 32 bp, Homo sapiens
caggttgttcacttgctgaggtgcaaaaattc

SEQ ID NO: 16056 - DNA, 32 bp, Homo sapiens
ggccacgatgtaggctccactttgccaacttc

SEQ ID NO: 16057 - DNA, 32 bp, Homo sapiens
caccctgtgctgctgaggtgcgtagctgcaca

SEQ ID NO: 16058 - DNA, 32 bp, Homo sapiens
gcgccgcggctgctgctgcgcaggcccagtgc

SEQ ID NO: 16059 - DNA, 32 bp, Homo sapiens
ggaggccgaggcagttggattacttgaggcca

SEQ ID NO: 16060 - DNA, 32 bp, Homo sapiens
ggcgcatgcctgtaatcccagcactttgggag

SEQ ID NO: 16061 - DNA, 32 bp, Homo sapiens
ggctcatgcctgtaatcccagcacttttggag

SEQ ID NO: 16062 - DNA, 32 bp, Homo sapiens
ccaggtgcaggttgggaatgaggcttgctgag

SEQ ID NO: 16063 - DNA, 32 bp, Homo sapiens
ggaggaggaaggaaagaaagaaagcgagggag

SEQ ID NO: 16064 - DNA, 32 bp, Homo sapiens
gagcctgggagtttgaggctgcagtgagctat

SEQ ID NO: 16065 - DNA, 32 bp, Homo sapiens
aacaactgtctacgtgcttcccatgatatgtt

SEQ ID NO: 16066 - DNA, 24 bp, Homo sapiens
tggtgcaatcttggctcactatag

SEQ ID NO: 16067 - DNA, 32 bp, Homo sapiens
ggccctcctcaaggtcagccttcagatttggg

SEQ ID NO: 16068 - DNA, 32 bp, Homo sapiens
cctaagccctaaggagctcctcagcttgaaat

SEQ ID NO: 16069 - DNA, 32 bp, Homo sapiens
aagaaatttgtcaggctgggtgcagtggctca

SEQ ID NO: 16070 - DNA, 32 bp, Homo sapiens
ctctgttgcccaagctggagtgaagtggtaca

SEQ ID NO: 16071 - DNA, 32 bp, Homo sapiens
ctcctgccctggatctggagtggagctgctct

SEQ ID NO: 16072 - DNA, 32 bp, Homo sapiens
agcctcctgagtagctgggactacaggtgtgt

SEQ ID NO: 16073 - DNA, 32 bp, Homo sapiens
gttcaaagagattgactgctgtggagacagat

SEQ ID NO: 16074 - DNA, 32 bp, Homo sapiens
ctcactgcactcaggctggagtgcagtggtac

SEQ ID NO: 16075 - DNA, 32 bp, Homo sapiens
tatatttgaaataagatcctggaaacgaattt

SEQ ID NO: 16076 - DNA, 32 bp, Homo sapiens
acctctacctcctgggttcaagcaatcctcct

SEQ ID NO: 16077 - DNA, 32 bp, Homo sapiens
aactgtaaccgattgtatgactgctgcactta

SEQ ID NO: 16078 - DNA, 23 bp, Homo sapiens
tgtaagaaaaagttgagtgggga

SEQ ID NO: 16079 - DNA, 32 bp, Homo sapiens
tctgaggaagaactgtctgggtgcaaaagtcc

SEQ ID NO: 16080 - DNA, 32 bp, Homo sapiens
aaatgggcaaggcagagtaagcaggggagaca

SEQ ID NO: 16081 - DNA, 24 bp, Homo sapiens
gtcgcccagactggagtgcagtag

SEQ ID NO: 16082 - DNA, 32 bp, Homo sapiens
tctggatcttaaggagcttccatttctccagc

SEQ ID NO: 16083 - DNA, 32 bp, Homo sapiens
tcctcagcctgatcctggaagagactcggggc

SEQ ID NO: 16084 - DNA, 32 bp, Homo sapiens
cctcccctgtacctctcgtaccacagaggaca

SEQ ID NO: 16085 - DNA, 23 bp, Homo sapiens
tggcacgatcgcggctcactgca

SEQ ID NO: 16086 - DNA, 32 bp, Homo sapiens
gtgcatcatccctcatgagaggcaagcccaga

SEQ ID NO: 16087 - DNA, 32 bp, Homo sapiens
gctctatcgcccaggatggagtgcagtggctc

SEQ ID NO: 16088 - DNA, 32 bp, Homo sapiens
tcactgttgccaggctggagtgcagtggcaca

SEQ ID NO: 16089 - DNA, 32 bp, Homo sapiens
ctctgtcgcccagggtggagtgcagtggcgtg

SEQ ID NO: 16090 - DNA, 19 bp, Homo sapiens
cctgtaattccagcacttt

SEQ ID NO: 16091 - DNA, 19 bp, Homo sapiens
tctgtaatcccagcacttt

SEQ ID NO: 16092 - DNA, 32 bp, Homo sapiens
gccaatggtaccacccagtttcctgagctaag

SEQ ID NO: 16093 - DNA, 32 bp, Homo sapiens
ttctttcctcaaggagactccagcacctatgc

SEQ ID NO: 16094 - DNA, 32 bp, Homo sapiens
aaaatcccacccatgttgtaccaccttggtga

SEQ ID NO: 16095 - DNA, 32 bp, Homo sapiens
tcaactgcaacattttcttttctgcctatctt

SEQ ID NO: 16096 - DNA, 32 bp, Homo sapiens
tagaacagctgggaaaaagaaaataatccatt

SEQ ID NO: 16097 - DNA, 32 bp, Homo sapiens
agatgtcatcccttgtataccatcgtagactt

SEQ ID NO: 16098 - DNA, 24 bp, Homo sapiens
tcctgaagaaactgaacactgtca

SEQ ID NO: 16099 - DNA, 32 bp, Homo sapiens
agccgctgcccaggggagtggctgtggggagg

SEQ ID NO: 16100 - DNA, 32 bp, Homo sapiens
ctctgtctcccaggctggaggtcagtggcaca

SEQ ID NO: 16101 - DNA, 32 bp, Homo sapiens
ctctgtcccctaggctgcagtgcagtggcgcg

SEQ ID NO: 16102 - DNA, 32 bp, Homo sapiens
gacctgccctccattctatctactccctctct

SEQ ID NO: 16103 - DNA, 32 bp, Homo sapiens
tagaagaaagagaaaccttcactttggcattt

SEQ ID NO: 16104 - DNA, 32 bp, Homo sapiens
ggaccttgtcccaggctgggcagaggtcagga

SEQ ID NO: 16105 - DNA, 32 bp, Homo sapiens
aaaactcaacatcaaatgctctgatgtgctat

SEQ ID NO: 16106 - DNA, 23 bp, Homo sapiens
tggcgctatctcggctcactgca

SEQ ID NO: 16107 - DNA, 23 bp, Homo sapiens
tggcactatctcagctcactgca

SEQ ID NO: 16108 - DNA, 32 bp, Homo sapiens
aagggattctaccagtatgtgctactactaac

SEQ ID NO: 16109 - DNA, 20 bp, Homo sapiens
gcccggacctcggcctcccc

SEQ ID NO: 16110 - DNA, 32 bp, Homo sapiens
gcccccagaagaagctggagtgcatagtgcgg

SEQ ID NO: 16111 - DNA, 32 bp, Homo sapiens
tcgaaaagaaaaggagaaataaatcaaacagc

SEQ ID NO: 16112 - DNA, 32 bp, Homo sapiens
ctctgccgcccaggctggagtgcagtggcgcg

SEQ ID NO: 16113 - DNA, 32 bp, Homo sapiens
ctctgttgcccaggctggagtgcactggcttg

SEQ ID NO: 16114 - DNA, 32 bp, Homo sapiens
tgctccagcccaggctggagtgcagtggcatg

SEQ ID NO: 16115 - DNA, 32 bp, Homo sapiens
gttctgtcgcccaggctggcgtgcagtggcgc

SEQ ID NO: 16116 - DNA, 32 bp, Homo sapiens
gctctgtcacccaggcttgagtgcagtggtgc

SEQ ID NO: 16117 - DNA, 32 bp, Homo sapiens
gctctgtcacccaggttggagtgcattggtgt

SEQ ID NO: 16118 - DNA, 32 bp, Homo sapiens
gaacccagaaggcagaggttgcagtgagctga

SEQ ID NO: 16119 - DNA, 32 bp, Homo sapiens
tcaacgccaagtcatcctcccacctcagcctc

SEQ ID NO: 16120 - DNA, 32 bp, Homo sapiens
gaacccaggaggcagaagttgcagtgagctga

SEQ ID NO: 16121 - DNA, 32 bp, Homo sapiens
gaacctgggaggaggaggttgcagtgagctga

SEQ ID NO: 16122 - DNA, 32 bp, Homo sapiens
caacctgggagatggaggttgcagtgagccga

SEQ ID NO: 16123 - DNA, 32 bp, Homo sapiens
aaactcagtggataagcatctttgtcatattt

SEQ ID NO: 16124 - DNA, 25 bp, Homo sapiens
tcatgtttgtaaatcccagcacttt

SEQ ID NO: 16125 - DNA, 32 bp, Homo sapiens
cctagacatggaggagaaggactacagtgagg

SEQ ID NO: 16126 - DNA, 18 bp, Homo sapiens
cccgggctggagtgcaat

SEQ ID NO: 16127 - DNA, 32 bp, Homo sapiens
ggtttgcagttttcactcaagttttgcatgaa

SEQ ID NO: 16128 - DNA, 32 bp, Homo sapiens
ggcaaatctgcagccgctcgctttctcctctg

SEQ ID NO: 16129 - DNA, 32 bp, Homo sapiens
ctcggctcaagcaatccttcctactcagcctc

SEQ ID NO: 16130 - DNA, 32 bp, Homo sapiens
ctgagctcaagcaatcctcccacctcagcctt

SEQ ID NO: 16131 - DNA, 18 bp, Homo sapiens
cagggcgtcctccagctc

SEQ ID NO: 16132 - DNA, 32 bp, Homo sapiens
gcctccgcctcccgggttcaagcgattctccc

SEQ ID NO: 16133 - DNA, 24 bp, Homo sapiens
tcacgcctgtaatcccagcagttt

SEQ ID NO: 16134 - DNA, 32 bp, Homo sapiens
ttccctctgagctacttcctgggcatagttac

SEQ ID NO: 16135 - DNA, 32 bp, Homo sapiens
acctccacctcccaggttcaagcaattctcct

SEQ ID NO: 16136 - DNA, 32 bp, Homo sapiens
ttcctgcatcttctcaccccctcaaccaggaa

SEQ ID NO: 16137 - DNA, 24 bp, Homo sapiens
tcactcctgtaatcccagcatttt

SEQ ID NO: 16138 - DNA, 24 bp, Homo sapiens
tcacccctgtaatcccagcacttt

SEQ ID NO: 16139 - DNA, 32 bp, Homo sapiens
caaaggggcagggcctggctttgctacaagat

SEQ ID NO: 16140 - DNA, 32 bp, Homo sapiens
ctctgtcgcctaagctggagtgtggtggcacg

SEQ ID NO: 16141 - DNA, 32 bp, Homo sapiens
aagcagtggaggctcagccactgtgaggaggt

SEQ ID NO: 16142 - DNA, 27 bp, Homo sapiens
ggatgaaggattcctgcatcactgtga

SEQ ID NO: 16143 - DNA, 32 bp, Homo sapiens
tgggaaagcccaggccgcaggagtgggatgcc

SEQ ID NO: 16144 - DNA, 32 bp, Homo sapiens
ctctgtcacccaggccggagtgcagtggtgcg

SEQ ID NO: 16145 - DNA, 32 bp, Homo sapiens
ggctcatgcctgtaatcctagcactttggggg

SEQ ID NO: 16146 - DNA, 32 bp, Homo sapiens
gccctcccaaagtgttgggattataggcatga

SEQ ID NO: 16147 - DNA, 32 bp, Homo sapiens
catcaacagactgggagggattacgtggggtc

SEQ ID NO: 16148 - DNA, 32 bp, Homo sapiens
ggatttttaaagattcttcccaccttaatttt

SEQ ID NO: 16149 - DNA, 32 bp, Homo sapiens
ctgggttcaagcaatcctcctgccttatcctc

SEQ ID NO: 16150 - DNA, 32 bp, Homo sapiens
ggctcatgcctgtagtcctagcactttgggag

SEQ ID NO: 16151 - DNA, 32 bp, Homo sapiens
cttgaaaattgatatcctgtggtgctaaagta

SEQ ID NO: 16152 - DNA, 19 bp, Homo sapiens
caggtagattctgcctgaa

SEQ ID NO: 16153 - DNA, 32 bp, Homo sapiens
gctttttcagatcagtctccacagctaccatc

SEQ ID NO: 16154 - DNA, 32 bp, Homo sapiens
ccaggctcacccaggctggggtctgagtgtca

SEQ ID NO: 16155 - DNA, 32 bp, Homo sapiens
gagatccgtgaattctcggaatggcaggggaa

SEQ ID NO: 16156 - DNA, 32 bp, Homo sapiens
attccaggtgttccctggaaaggtcaagtgag

SEQ ID NO: 16157 - DNA, 23 bp, Homo sapiens
tcacgcctgtaatccagcacttt

SEQ ID NO: 16158 - DNA, 32 bp, Homo sapiens
agaagaagctgaacttcagactgtgaaaggta

SEQ ID NO: 16159 - DNA, 32 bp, Homo sapiens
cccaccctcatggagcctccagtctagctgcc

SEQ ID NO: 16160 - DNA, 16 bp, Homo sapiens
gtggggagaaagtggg

SEQ ID NO: 16161 - DNA, 32 bp, Homo sapiens
cctcagccagtcgctatgcagcactttcggac

SEQ ID NO: 16162 - DNA, 32 bp, Homo sapiens
ttgctcttgcccaggcaggagtacagtagtgc

SEQ ID NO: 16163 - DNA, 32 bp, Homo sapiens
ctcttattgcccaggctggagtgcagtgacga

SEQ ID NO: 16164 - DNA, 32 bp, Homo sapiens
gaacctgggaggcggaggttgcagggagctga

SEQ ID NO: 16165 - DNA, 32 bp, Homo sapiens
ccgtccgagaggcagagctgacaaggaaggtt

SEQ ID NO: 16166 - DNA, 32 bp, Homo sapiens
ctcgctgtgtcccaggttcaagcagttctcct

SEQ ID NO: 16167 - DNA, 32 bp, Homo sapiens
aacatatattggagagaagccctgttatggtc

SEQ ID NO: 16168 - DNA, 21 bp, Homo sapiens
tcacacctgtaatcccagcct

SEQ ID NO: 16169 - DNA, 23 bp, Homo sapiens
cagtcagggccaagagagcagtg

SEQ ID NO: 16170 - DNA, 32 bp, Homo sapiens
tctgcagctgtagattctcactgtgaatccct

SEQ ID NO: 16171 - DNA, 32 bp, Homo sapiens
caggcagcaccaaaggtttttgtcttgggaag

SEQ ID NO: 16172 - DNA, 32 bp, Homo sapiens
ggaatccccaaaaagataacatttttcttctg

SEQ ID NO: 16173 - DNA, 32 bp, Homo sapiens
aggctggatggacttcaacttggagttgagtt

SEQ ID NO: 16174 - DNA, 32 bp, Homo sapiens
tggctgcctgggcacctctcccaggaagtggt

SEQ ID NO: 16175 - DNA, 32 bp, Homo sapiens
tcttgttgcccaggctggagtgcagtagcact

SEQ ID NO: 16176 - DNA, 32 bp, Homo sapiens
catctcaggcctggctggctcttctgtgcttt

SEQ ID NO: 16177 - DNA, 32 bp, Homo sapiens
taaccggaggcaggctgggtgcagtggctcat

SEQ ID NO: 16178 - DNA, 32 bp, Homo sapiens
ctttgtcgcccgggcaggagtgcagtggctca

SEQ ID NO: 16179 - DNA, 32 bp, Homo sapiens
ctaatactaagtgcccaacctgacaacagaga

SEQ ID NO: 16180 - DNA, 32 bp, Homo sapiens
agctcatgcctgtaatcctagcactttggaag

SEQ ID NO: 16181 - DNA, 32 bp, Homo sapiens
ctacaggaacaacagatgttgagtacttctag

SEQ ID NO: 16182 - DNA, 32 bp, Homo sapiens
acactagtgcttccgctggagtttgcagtttt

SEQ ID NO: 16183 - DNA, 32 bp, Homo sapiens
ggttgacatcttcatttctgggctactactat

SEQ ID NO: 16184 - DNA, 32 bp, Homo sapiens
ctaggaacatgcactagatgacagattgcggg

SEQ ID NO: 16185 - DNA, 32 bp, Homo sapiens
aaatgcagctagattcaaatgggctgataacc

SEQ ID NO: 16186 - DNA, 32 bp, Homo sapiens
cactcccccaaaatgacacccaccgtcgtcag

SEQ ID NO: 16187 - DNA, 32 bp, Homo sapiens
gtccattctgcagcgtttctctttcccttgga

SEQ ID NO: 16188 - DNA, 32 bp, Homo sapiens
gaagtaaatcttctccctaccccgtctgccag

SEQ ID NO: 16189 - DNA, 32 bp, Homo sapiens
gcccccacccttgacctcaacagggtcctgga

SEQ ID NO: 16190 - DNA, 32 bp, Homo sapiens
gggcagaggcctcctttcaaggagttcacagt

SEQ ID NO: 16191 - DNA, 32 bp, Homo sapiens
cctcaggttcccaagacttcagtcctggtctg

SEQ ID NO: 16192 - DNA, 32 bp, Homo sapiens
tcttgttgcccaggctggagtgcaacggcacg

SEQ ID NO: 16193 - DNA, 32 bp, Homo sapiens
ctctgctgcccgggctagagtgcagtggtggg

SEQ ID NO: 16194 - DNA, 32 bp, Homo sapiens
gaaaagaaaagaaaagaaagaaaggaattagg

SEQ ID NO: 16195 - DNA, 28 bp, Homo sapiens
agttctccagttgctgcctccttgtctt

SEQ ID NO: 16196 - DNA, 32 bp, Homo sapiens
ctactcgggaggctgaggcaggggaattgctt

SEQ ID NO: 16197 - DNA, 32 bp, Homo sapiens
acctccacctcccaggttcaagcgattcccct

SEQ ID NO: 16198 - DNA, 32 bp, Homo sapiens
accttcacctcccaggttcaagcgattctcct

SEQ ID NO: 16199 - DNA, 32 bp, Homo sapiens
atgccagggttagaggctagagagtggaagtc

SEQ ID NO: 16200 - DNA, 32 bp, Homo sapiens
acttcattacccaggctggagtgcaaggcacg

SEQ ID NO: 16201 - DNA, 32 bp, Homo sapiens
caactcgggaggctgaggcaggagaatggcgt

SEQ ID NO: 16202 - DNA, 32 bp, Homo sapiens
cctccccgcagctcttctcttccctctatgag

SEQ ID NO: 16203 - DNA, 32 bp, Homo sapiens
cctcaacctcttctccccacaaccccaacccc

SEQ ID NO: 16204 - DNA, 24 bp, Homo sapiens
tcacagctataatctcagcacttt

SEQ ID NO: 16205 - DNA, 32 bp, Homo sapiens
caagcaagaagaggagtggaagcacagttgcc

SEQ ID NO: 16206 - DNA, 32 bp, Homo sapiens
gaatgtagaagtggcatctgaaaacaattggt

SEQ ID NO: 16207 - DNA, 32 bp, Homo sapiens
atctttggattgatgttcacagctttatactt

SEQ ID NO: 16208 - DNA, 32 bp, Homo sapiens
aggaactcattatgctactggttgtttgggga

SEQ ID NO: 16209 - DNA, 32 bp, Homo sapiens
ctttgtcgcccaggctggagtgcaatgcacga

SEQ ID NO: 16210 - DNA, 32 bp, Homo sapiens
ctctgttacccatgctggagtacggtggcgag

SEQ ID NO: 16211 - DNA, 32 bp, Homo sapiens
cagcccccaagtgtccagcctggcacttccca

SEQ ID NO: 16212 - DNA, 32 bp, Homo sapiens
tacctcccaagtgcctggtacatagtgggtgc

SEQ ID NO: 16213 - DNA, 32 bp, Homo sapiens
cctttctggggagtgaggaatgtgggagagag

SEQ ID NO: 16214 - DNA, 28 bp, Homo sapiens
ccagagcccaggctggcctcatctgcac

SEQ ID NO: 16215 - DNA, 32 bp, Homo sapiens
atgtattgagtgtctgttaggtgcaaagtatg

SEQ ID NO: 16216 - DNA, 32 bp, Homo sapiens
aatcctcagagcaattctctgtattctcatat

SEQ ID NO: 16217 - DNA, 32 bp, Homo sapiens
cccggcagcccccatccatctgtgtctgtctg

SEQ ID NO: 16218 - DNA, 32 bp, Homo sapiens
tcttgtctcccagactggagtgcaatggcatg

SEQ ID NO: 16219 - DNA, 32 bp, Homo sapiens
cccaactctgcagggcttctctccctgccacc

SEQ ID NO: 16220 - DNA, 32 bp, Homo sapiens
tactccaccttcggtgccatctggactcccac

SEQ ID NO: 16221 - DNA, 32 bp, Homo sapiens
acctggacctcctgggctcaagcaatcctctc

SEQ ID NO: 16222 - DNA, 32 bp, Homo sapiens
gctctgtagcccaggctggagtgcagtgtggc

SEQ ID NO: 16223 - DNA, 32 bp, Homo sapiens
tttgagtcctcatccatggagtgctgtgtttg

SEQ ID NO: 16224 - DNA, 32 bp, Homo sapiens
ccaaaacctagagtggtagttttatgtaaatg

SEQ ID NO: 16225 - DNA, 32 bp, Homo sapiens
ggaaggtggagtttcctgctgttgcttgtgaa

SEQ ID NO: 16226 - DNA, 32 bp, Homo sapiens
ctaaacccagtgctgctctcccatctcccatc

SEQ ID NO: 16227 - DNA, 24 bp, Homo sapiens
tcacgcctgtagtcccagcatttt

SEQ ID NO: 16228 - DNA, 32 bp, Homo sapiens
cgcaggctgccaggctggcgtacagtggcgca

SEQ ID NO: 16229 - DNA, 32 bp, Homo sapiens
ctctgccgcccaggctggactgcagtgacaca

SEQ ID NO: 16230 - DNA, 32 bp, Homo sapiens
gaagggagaagaggccgaagaggaaacatgaa

SEQ ID NO: 16231 - DNA, 28 bp, Homo sapiens
atcccagcaagtgctgctctgctctgcc

SEQ ID NO: 16232 - DNA, 32 bp, Homo sapiens
ccgattctgagtagtgggatgaagtctcatgc

SEQ ID NO: 16233 - DNA, 32 bp, Homo sapiens
atgagaggggtgaggtctctgtggaaggacag

SEQ ID NO: 16234 - DNA, 32 bp, Homo sapiens
tctctgtcgcccaggctggagcccagtggcga

SEQ ID NO: 16235 - DNA, 18 bp, Homo sapiens
gccccttcccgtccaggt

SEQ ID NO: 16236 - DNA, 22 bp, Homo sapiens
gtgcatggtcctggggcagcaa

SEQ ID NO: 16237 - DNA, 32 bp, Homo sapiens
ggcctcccaaagtgctgggattactggcatga

SEQ ID NO: 16238 - DNA, 32 bp, Homo sapiens
ggtctccatcttctttcactcctgtggccctg

SEQ ID NO: 16239 - DNA, 32 bp, Homo sapiens
gggtacatcactcagcctttctggacccaatt

SEQ ID NO: 16240 - DNA, 32 bp, Homo sapiens
gaaaaatgttttgtacccatctggaaaaccaa

SEQ ID NO: 16241 - DNA, 32 bp, Homo sapiens
taacagccccaaggagcagcaggcatgggtcc

SEQ ID NO: 16242 - DNA, 32 bp, Homo sapiens
gcagggcagccatcctggatgatggaagccac

SEQ ID NO: 16243 - DNA, 26 bp, Homo sapiens
ttcactgcatgaagttgttcatttgg

SEQ ID NO: 16244 - DNA, 32 bp, Homo sapiens
gctctgcgcccaggatggagtgcagtggcatg

SEQ ID NO: 16245 - DNA, 32 bp, Homo sapiens
ctgaggagctggccctgccactgtggactgcc

SEQ ID NO: 16246 - DNA, 32 bp, Homo sapiens
ctggtggcagctatgtttaagagaccagcgtc

SEQ ID NO: 16247 - DNA, 32 bp, Homo sapiens
gaaacccacaggcggaggttgcggtgggctgg

SEQ ID NO: 16248 - DNA, 32 bp, Homo sapiens
gtaaaaggggcagcagggtagagcaggtgatg

SEQ ID NO: 16249 - DNA, 17 bp, Homo sapiens
tgggtgaatgatgggga

SEQ ID NO: 16250 - DNA, 32 bp, Homo sapiens
tcttacatgtagagatttgagtgcagttggta

SEQ ID NO: 16251 - DNA, 32 bp, Homo sapiens
catgtattacctgaattttggctgtgtctccc

SEQ ID NO: 16252 - DNA, 32 bp, Homo sapiens
agaggtgagaagggagaaaggagggagtgggc

SEQ ID NO: 16253 - DNA, 32 bp, Homo sapiens
gcaacaagcaagagagaaagaaacacagaaag

SEQ ID NO: 16254 - DNA, 32 bp, Homo sapiens
gtgttgctctccattcttttaaatctcgcact

SEQ ID NO: 16255 - DNA, 32 bp, Homo sapiens
agaaaccgggcttggttgttgcagtgggaaga

SEQ ID NO: 16256 - DNA, 32 bp, Homo sapiens
ctctgtcacccaggctggagtgcaatggcatg

SEQ ID NO: 16257 - DNA, 32 bp, Homo sapiens
ctctgtcgcccaggttggagtgccatggcacc

SEQ ID NO: 16258 - DNA, 32 bp, Homo sapiens
ccgggttcaagcaattctcctgcctcagctcc

SEQ ID NO: 16259 - DNA, 32 bp, Homo sapiens
ctctgttacccaggctagagtgtagtggcatg

SEQ ID NO: 16260 - DNA, 32 bp, Homo sapiens
ctctgttgcccaggctggagtgcaatggcaca

SEQ ID NO: 16261 - DNA, 32 bp, Homo sapiens
ctctgtcacccaggctggagtacaatggcgtg

SEQ ID NO: 16262 - DNA, 32 bp, Homo sapiens
gaacgcgggaggcagagactgcagtgagccga

SEQ ID NO: 16263 - DNA, 32 bp, Homo sapiens
ggctcctgagtagctggggattacaggtgcct

SEQ ID NO: 16264 - DNA, 32 bp, Homo sapiens
gctcagctgcccaggctggagtgtggtggcgc

SEQ ID NO: 16265 - DNA, 32 bp, Homo sapiens
aattcccaccacagactggcttgtacgtcctc

SEQ ID NO: 16266 - DNA, 19 bp, Homo sapiens
ggcatgcacacatatctcc

SEQ ID NO: 16267 - DNA, 32 bp, Homo sapiens
cacctccattggagggcaggactcttgattgt

SEQ ID NO: 16268 - DNA, 32 bp, Homo sapiens
agtctcccgagtagctgggattacaggcactt

SEQ ID NO: 16269 - DNA, 32 bp, Homo sapiens
ccccgtctgctgctggacacagagccatgaag

SEQ ID NO: 16270 - DNA, 32 bp, Homo sapiens
tgggccatcgccgcagcacaggcagcggcggc

SEQ ID NO: 16271 - DNA, 19 bp, Homo sapiens
ggctcttgcaacatctccc

SEQ ID NO: 16272 - DNA, 32 bp, Homo sapiens
ttgagatggagtttcactcttgtctcccagac

SEQ ID NO: 16273 - DNA, 23 bp, Homo sapiens
tgacatgatcttggctgactgca

SEQ ID NO: 16274 - DNA, 32 bp, Homo sapiens
tgcagtgtgctgcctacacctccacctccttc

SEQ ID NO: 16275 - DNA, 32 bp, Homo sapiens
ttctgttgcccaggctggagtgcaatggcatg

SEQ ID NO: 16276 - DNA, 32 bp, Homo sapiens
aaaacataatcccaactgggtgcagtggctca

SEQ ID NO: 16277 - DNA, 32 bp, Homo sapiens
aagtgagattgaagagaatgaaaacaaatttg

SEQ ID NO: 16278 - DNA, 32 bp, Homo sapiens
gaaagcctagagaccgccactgtgattcacct

SEQ ID NO: 16279 - DNA, 32 bp, Homo sapiens
aagcccaggaggccaagtctgcagtgagctat

SEQ ID NO: 16280 - DNA, 32 bp, Homo sapiens
agccttctgagtagctgggactacaggtgtgc

SEQ ID NO: 16281 - DNA, 32 bp, Homo sapiens
agcctcccaagtagctgggattacaggcagac

SEQ ID NO: 16282 - DNA, 32 bp, Homo sapiens
aagccccattccattcctacagatctctcagc

SEQ ID NO: 16283 - DNA, 32 bp, Homo sapiens
gctctgtcaccaggctggagtgcagtgacacg

SEQ ID NO: 16284 - DNA, 32 bp, Homo sapiens
cagctttgacctttattcaagagaccagatgg

SEQ ID NO: 16285 - DNA, 24 bp, Homo sapiens
tcatgggtggcgggtatgatctca

SEQ ID NO: 16286 - DNA, 32 bp, Homo sapiens
gaacccgggaggcagaggctgcagtgagctga

SEQ ID NO: 16287 - DNA, 28 bp, Homo sapiens
gttttccctactgctgcctgatccctcg

SEQ ID NO: 16288 - DNA, 32 bp, Homo sapiens
actctgttgcccaggctggaatgcagtgatac

SEQ ID NO: 16289 - DNA, 32 bp, Homo sapiens
gcacatgcctcgcgttcttcccagaaagtcag

SEQ ID NO: 16290 - DNA, 32 bp, Homo sapiens
gaacccaggaggtggagtttgcagtgagctga

SEQ ID NO: 16291 - DNA, 32 bp, Homo sapiens
agcatctcgagtagctgggattacaggcatgc

SEQ ID NO: 16292 - DNA, 32 bp, Homo sapiens
gctctgtcacccaggctggagtgcagtggtat

SEQ ID NO: 16293 - DNA, 32 bp, Homo sapiens
gctctgtcacccagactggagtgcagtggtgt

SEQ ID NO: 16294 - DNA, 32 bp, Homo sapiens
gtggcttggagttttgttgttgttttcttggt

SEQ ID NO: 16295 - DNA, 32 bp, Homo sapiens
tttttccactttggaaaatgtcactgtgacaa

SEQ ID NO: 16296 - DNA, 23 bp, Homo sapiens
agtggggatctcaagctcttgga

SEQ ID NO: 16297 - DNA, 32 bp, Homo sapiens
ccagtacctttcctaagtctttgctcaaatta

SEQ ID NO: 16298 - DNA, 32 bp, Homo sapiens
ctagtgccagttcttatgctaagcaggttacg

SEQ ID NO: 16299 - DNA, 32 bp, Homo sapiens
actttaaatcaaattgaaaataaattttatcc

SEQ ID NO: 16300 - DNA, 32 bp, Homo sapiens
tgtcgctagtcctaaggagaaacctttaacca

SEQ ID NO: 16301 - DNA, 32 bp, Homo sapiens
acctccgcctcctgggttcaagcagttctctt

SEQ ID NO: 16302 - DNA, 32 bp, Homo sapiens
ccaggctcaaaagatgctcccaccacagcctc

SEQ ID NO: 16303 - DNA, 32 bp, Homo sapiens
gctcatacctgtaaatcccagcactttgggag

SEQ ID NO: 16304 - DNA, 32 bp, Homo sapiens
ccatggtctcccggctggcaatgtggtgaagc

SEQ ID NO: 16305 - DNA, 32 bp, Homo sapiens
gccaaacttaaccttggtggggtttggatttg

SEQ ID NO: 16306 - DNA, 32 bp, Homo sapiens
cagtggccttttctccccctcaccttctaagg

SEQ ID NO: 16307 - DNA, 19 bp, Homo sapiens
catgcctataatcccagca

SEQ ID NO: 16308 - DNA, 32 bp, Homo sapiens
ggagggcgaagaggaggaggaaggggaggacg

SEQ ID NO: 16309 - DNA, 32 bp, Homo sapiens
gcttaggtttttctgtcatcctcagatcccac

SEQ ID NO: 16310 - DNA, 32 bp, Homo sapiens
ggtgggagcctgtggcttatggcttcacttac

SEQ ID NO: 16311 - DNA, 32 bp, Homo sapiens
gctctgtctcccaggctggagtgcagtgacac

SEQ ID NO: 16312 - DNA, 32 bp, Homo sapiens
cactcgttgcccaggctggagtgcagtggcgc

SEQ ID NO: 16313 - DNA, 32 bp, Homo sapiens
agcgtcagactccattatgtactgactgtgtg

SEQ ID NO: 16314 - DNA, 21 bp, Homo sapiens
tcacacctgtgatctcagcac

SEQ ID NO: 16315 - DNA, 32 bp, Homo sapiens
ttgtgcagccgatttcaaggctaagagagaaa

SEQ ID NO: 16316 - DNA, 32 bp, Homo sapiens
ggacaggaagagaccttatttcctgatgggac

SEQ ID NO: 16317 - DNA, 24 bp, Homo sapiens
tccctgtgcagcattcaaaaatca

SEQ ID NO: 16318 - DNA, 32 bp, Homo sapiens
ggactcctcttcctctctcttctcctactctg

SEQ ID NO: 16319 - DNA, 32 bp, Homo sapiens
tagaccatgatctccttggaagcagggacagt

SEQ ID NO: 16320 - DNA, 32 bp, Homo sapiens
gaactcaggaggcagaggttgcaatgagccaa

SEQ ID NO: 16321 - DNA, 32 bp, Homo sapiens
ccctgctccgaggccttcctgggttgctgtcc

SEQ ID NO: 16322 - DNA, 28 bp, Homo sapiens
agcagcccaagtgctcctgagtccttgc

SEQ ID NO: 16323 - DNA, 32 bp, Homo sapiens
gagggtggaagaggagagggtggaaggggaat

SEQ ID NO: 16324 - DNA, 32 bp, Homo sapiens
gctctgttgtccaggctggagggcagtgacat

SEQ ID NO: 16325 - DNA, 32 bp, Homo sapiens
tgagcctgggagcgcaggttgcaatgagccaa

SEQ ID NO: 16326 - DNA, 21 bp, Homo sapiens
agctcctgcctccaagtgctg

SEQ ID NO: 16327 - DNA, 32 bp, Homo sapiens
aatgcaaactagttcagccactgtggagagaa

SEQ ID NO: 16328 - DNA, 32 bp, Homo sapiens
tggtcccatcttctgcccgctcctccaggaaa

SEQ ID NO: 16329 - DNA, 32 bp, Homo sapiens
ctcggcggcggcgggcagttgcagtggtgcag

SEQ ID NO: 16330 - DNA, 31 bp, Homo sapiens
gcaagaatgaactccttcctggaatacccca

SEQ ID NO: 16331 - DNA, 28 bp, Homo sapiens
ggggcctccagtgctgcccctcctccct

SEQ ID NO: 16332 - DNA, 32 bp, Homo sapiens
ggatgtgggtgtccctggctctgtgagtcttc

SEQ ID NO: 16333 - DNA, 32 bp, Homo sapiens
ggcctcccaaagtgctgggattatggacgtga

SEQ ID NO: 16334 - DNA, 32 bp, Homo sapiens
ttctttttgcccaggcctggactttttgcatc

SEQ ID NO: 16335 - DNA, 32 bp, Homo sapiens
cacacacatcacttgcccatctggcactaaag

SEQ ID NO: 16336 - DNA, 32 bp, Homo sapiens
ctgacctcaggcaatctgcccacctcagcctc

SEQ ID NO: 16337 - DNA, 32 bp, Homo sapiens
ctggcctcaagcaatgttcccatgtcagccta

SEQ ID NO: 16338 - DNA, 32 bp, Homo sapiens
ttgattgtccctggatggagtgcagtcacctt

SEQ ID NO: 16339 - DNA, 32 bp, Homo sapiens
ttaaaggagccagccaggtgtaatacagtcaa

SEQ ID NO: 16340 - DNA, 23 bp, Homo sapiens
tggcgcaaccttggctcactgca

SEQ ID NO: 16341 - DNA, 32 bp, Homo sapiens
gaacccgggaggcggaggttatggagagccaa

SEQ ID NO: 16342 - DNA, 25 bp, Homo sapiens
gctgtggcccaggctgaagtgcagt

SEQ ID NO: 16343 - DNA, 32 bp, Homo sapiens
aaaaacctgagtatcattgcatgaatttttat

SEQ ID NO: 16344 - DNA, 32 bp, Homo sapiens
tctttctagagtagctcccatatatggagatg

SEQ ID NO: 16345 - DNA, 32 bp, Homo sapiens
acagaaagaagaaaggaaagaaaggaaccaga

SEQ ID NO: 16346 - DNA, 32 bp, Homo sapiens
gaccacatggagggaaaaagaaaacaattctt

SEQ ID NO: 16347 - DNA, 32 bp, Homo sapiens
ggatcatgcctgtaatcccagcactttgggaa

SEQ ID NO: 16348 - DNA, 23 bp, Homo sapiens
catgcctataatcccagcacttt

SEQ ID NO: 16349 - DNA, 24 bp, Homo sapiens
tcatgcctgtaatcccaaaacttt

SEQ ID NO: 16350 - DNA, 24 bp, Homo sapiens
tcatgggcaagaagcctgacccca

SEQ ID NO: 16351 - DNA, 23 bp, Homo sapiens
tggcacgatctcagctccctgca

SEQ ID NO: 16352 - DNA, 32 bp, Homo sapiens
gtcctgctgctgctgccgttccggtgtcagcg

SEQ ID NO: 16353 - DNA, 32 bp, Homo sapiens
tttcctgtggagctgctcagtgcccggcttag

SEQ ID NO: 16354 - DNA, 32 bp, Homo sapiens
ctctattgttcagactggagtgcagtggcatg

SEQ ID NO: 16355 - DNA, 32 bp, Homo sapiens
ctctgtcacctaggctagagtgcagtggtgtg

SEQ ID NO: 16356 - DNA, 32 bp, Homo sapiens
tccctccgaagaggagtccgaagaggacagcg

SEQ ID NO: 16357 - DNA, 32 bp, Homo sapiens
agcctcctgagtagctgggattataggtgcat

SEQ ID NO: 16358 - DNA, 32 bp, Homo sapiens
actctgccgcccaggctggactgcagtgacac

SEQ ID NO: 16359 - DNA, 32 bp, Homo sapiens
ccaggttcgggcaattctcctgcctcagcctc

SEQ ID NO: 16360 - DNA, 32 bp, Homo sapiens
agcctcccgagtagctgggattacaggtgcat

SEQ ID NO: 16361 - DNA, 32 bp, Homo sapiens
agcctcctgagcagctgggattacaggcgcac

SEQ ID NO: 16362 - DNA, 21 bp, Homo sapiens
tggcatgatcttggctcactg

SEQ ID NO: 16363 - DNA, 24 bp, Homo sapiens
tggtgcaatcttggctcactgcag

SEQ ID NO: 16364 - DNA, 24 bp, Homo sapiens
tcacattcgtaatcccagcacttt

SEQ ID NO: 16365 - DNA, 32 bp, Homo sapiens
ctctgtagcccaggccagagtgcagtggcgcg

SEQ ID NO: 16366 - DNA, 32 bp, Homo sapiens
tgccatctcagttgctgcagtgcagtgaatta

SEQ ID NO: 16367 - DNA, 32 bp, Homo sapiens
tgtgcagagccatagtcccactgtgggtcctg

SEQ ID NO: 16368 - DNA, 32 bp, Homo sapiens
gaacctggtaggcagaggttgtagtgagccga

SEQ ID NO: 16369 - DNA, 32 bp, Homo sapiens
gaacccggtaggcagaggttgcagtgagccga

SEQ ID NO: 16370 - DNA, 32 bp, Homo sapiens
caatgtgggaggcaggatgcagggatgggctc

SEQ ID NO: 16371 - DNA, 32 bp, Homo sapiens
ctgtcttctcttctgtctcttctctttcatct

SEQ ID NO: 16372 - DNA, 32 bp, Homo sapiens
agcctcctgagtagctgggactgcagaagtgc

SEQ ID NO: 16373 - DNA, 32 bp, Homo sapiens
ctaaaatgtgaaccgttgggtgatctgtcctt

SEQ ID NO: 16374 - DNA, 32 bp, Homo sapiens
catcccaagcaaggagccccagtctcccgagc

SEQ ID NO: 16375 - DNA, 32 bp, Homo sapiens
cacggtaatgttggactcggtgacacacagca

SEQ ID NO: 16376 - DNA, 32 bp, Homo sapiens
tacctgcagcttttcctgcttgatatagcaca

SEQ ID NO: 16377 - DNA, 32 bp, Homo sapiens
tcttgttgcccaggctgaagtgcagtgttgtg

SEQ ID NO: 16378 - DNA, 18 bp, Homo sapiens
gacattccaccattgtga

SEQ ID NO: 16379 - DNA, 18 bp, Homo sapiens
gccatcactaccaaccag

SEQ ID NO: 16380 - DNA, 32 bp, Homo sapiens
aactctgcctcccgggttcaagcaattctcct

SEQ ID NO: 16381 - DNA, 28 bp, Homo sapiens
ctgctcccaagtgcaacctctgtctgac

SEQ ID NO: 16382 - DNA, 32 bp, Homo sapiens
aacaggaaagagagttacaccttgtgggtgtg

SEQ ID NO: 16383 - DNA, 32 bp, Homo sapiens
gaacaaggtaggcagaggttgcagtgagccaa

SEQ ID NO: 16384 - DNA, 32 bp, Homo sapiens
atctccacctcccaggttcaagcaattctcct

SEQ ID NO: 16385 - DNA, 23 bp, Homo sapiens
ctgttgtccaggctggagtgcag

SEQ ID NO: 16386 - DNA, 32 bp, Homo sapiens
agcttcctgaggagctgggattataggtgcat

SEQ ID NO: 16387 - DNA, 32 bp, Homo sapiens
gatgagcgcttccaggcttcaggctcagaagg

SEQ ID NO: 16388 - DNA, 32 bp, Homo sapiens
aagaagaggaggaagacgaggattaatttcat

SEQ ID NO: 16389 - DNA, 32 bp, Homo sapiens
ccagattcaagcaattctcctgcctcagcctc

SEQ ID NO: 16390 - DNA, 32 bp, Homo sapiens
ccaggttcaagcagttctctgccccaccctcc

SEQ ID NO: 16391 - DNA, 32 bp, Homo sapiens
cgcggccatttcagccccatcttggcccagcg

SEQ ID NO: 16392 - DNA, 18 bp, Homo sapiens
gcccctgcccaccaggta

SEQ ID NO: 16393 - DNA, 32 bp, Homo sapiens
tttgttaatttccatgggaagccatgatggcc

SEQ ID NO: 16394 - DNA, 32 bp, Homo sapiens
agagcgcaaagtgctagccactggaaatgcat

SEQ ID NO: 16395 - DNA, 32 bp, Homo sapiens
ccttctcagaaaacttctcttctgagcctctt

SEQ ID NO: 16396 - DNA, 32 bp, Homo sapiens
gcagtcctgatagcttctctagcctcggtctt

SEQ ID NO: 16397 - DNA, 32 bp, Homo sapiens
ctctcttgcccaggctggagtgcagtggtatg

SEQ ID NO: 16398 - DNA, 32 bp, Homo sapiens
ctctgtcgcccaggctggagggcagtggcacg

SEQ ID NO: 16399 - DNA, 32 bp, Homo sapiens
ctctggaagcggtactgtatctctctccaagg

SEQ ID NO: 16400 - DNA, 32 bp, Homo sapiens
aagaatggcttcaggctggggctgcagtcacc

SEQ ID NO: 16401 - DNA, 32 bp, Homo sapiens
tgcagatggaggcagtggctggagtgaatgaa

SEQ ID NO: 16402 - DNA, 32 bp, Homo sapiens
ctactcgggaggctgaggcaggagattcgcct

SEQ ID NO: 16403 - DNA, 32 bp, Homo sapiens
ggtgtccatcttcttgctgttgaggaccctga

SEQ ID NO: 16404 - DNA, 32 bp, Homo sapiens
ctccagcatcttcttccccttccctggccctg

SEQ ID NO: 16405 - DNA, 32 bp, Homo sapiens
ggaaagaaagagatcgcagcaggggtgaaggg

SEQ ID NO: 16406 - DNA, 17 bp, Homo sapiens
gcaaaatgatgctttcc

SEQ ID NO: 16407 - DNA, 32 bp, Homo sapiens
ggctttcctcaaggatccctcaagtttccaac

SEQ ID NO: 16408 - DNA, 32 bp, Homo sapiens
ctctgccttcaaggagcttgcagtatagtgag

SEQ ID NO: 16409 - DNA, 32 bp, Homo sapiens
gccatgtggaactgctggagtgcagtggcatg

SEQ ID NO: 16410 - DNA, 32 bp, Homo sapiens
agtaagcaccagctgcctctttgctgctttgt

SEQ ID NO: 16411 - DNA, 32 bp, Homo sapiens
cgtttccacatcctgctctgctgcaggagagg

SEQ ID NO: 16412 - DNA, 32 bp, Homo sapiens
ggtatgggcagcccaaggttgcatgggaaaac

SEQ ID NO: 16413 - DNA, 32 bp, Homo sapiens
gaacccaggaggcagaggttgcagtgcgctga

SEQ ID NO: 16414 - DNA, 32 bp, Homo sapiens
agtgggtgaggacaggcttcaggctgtctctt

SEQ ID NO: 16415 - DNA, 32 bp, Homo sapiens
tcagccaggtaaagggactcactgtgatcgtg

SEQ ID NO: 16416 - DNA, 32 bp, Homo sapiens
ttgccatctcagttgctgcagtgcagtgaatt

SEQ ID NO: 16417 - DNA, 32 bp, Homo sapiens
tataacactatgcattaaaagcactttttgta

SEQ ID NO: 16418 - DNA, 32 bp, Homo sapiens
attttcccaacaagtagaaacacttaaaatca

SEQ ID NO: 16419 - DNA, 32 bp, Homo sapiens
aggtgcgggaccatctgatgtgatgtgaatac

SEQ ID NO: 16420 - DNA, 32 bp, Homo sapiens
gttcactctgcagttctcttgcctactgccat

SEQ ID NO: 16421 - DNA, 32 bp, Homo sapiens
aggaaacaggaaagagaaagaaaaggaaggaa

SEQ ID NO: 16422 - DNA, 32 bp, Homo sapiens
ctgggctcaagcaatcctcccaccttggcttc

SEQ ID NO: 16423 - DNA, 32 bp, Homo sapiens
ggaggggcccgccttagccatgtgaaggtgga

SEQ ID NO: 16424 - DNA, 32 bp, Homo sapiens
gggggatggagtttcgctgttgttgcccaggc

SEQ ID NO: 16425 - DNA, 32 bp, Homo sapiens
atctccatgccagcagggtgccttttatatga

SEQ ID NO: 16426 - DNA, 32 bp, Homo sapiens
atcgcagttgctccggatctttgcacacactc

SEQ ID NO: 16427 - DNA, 32 bp, Homo sapiens
ttattggaaagaggagacagaatgacaagata

SEQ ID NO: 16428 - DNA, 32 bp, Homo sapiens
ggtcactaattatctcaaaatatttcatacta

SEQ ID NO: 16429 - DNA, 32 bp, Homo sapiens
gaaacaaggaggcacttcctgtaggagcactg

SEQ ID NO: 16430 - DNA, 32 bp, Homo sapiens
gcctcgaactcctgggctcaagcaatcctcct

SEQ ID NO: 16431 - DNA, 32 bp, Homo sapiens
ttcgccttatgttcttcttgccggactctttt

SEQ ID NO: 16432 - DNA, 32 bp, Homo sapiens
agccttccaagtagctgggattacaggagtta

SEQ ID NO: 16433 - DNA, 32 bp, Homo sapiens
cagaatatacagaaagcaacaaacttcgtaaa

SEQ ID NO: 16434 - DNA, 32 bp, Homo sapiens
caaaagtggccaggctggaggtcttctaatgt

SEQ ID NO: 16435 - DNA, 19 bp, Homo sapiens
cagtgggctccttccagcc

SEQ ID NO: 16436 - DNA, 23 bp, Homo sapiens
tggcgtgatcttggttcactgca

SEQ ID NO: 16437 - DNA, 32 bp, Homo sapiens
gcctgcaggttagaaagaggcgagcgtggatt

SEQ ID NO: 16438 - DNA, 32 bp, Homo sapiens
gaacctgggaggcagaggttgcagtgaacaga

SEQ ID NO: 16439 - DNA, 32 bp, Homo sapiens
ttctgtgcttcctggttttgcaattggattga

SEQ ID NO: 16440 - DNA, 31 bp, Homo sapiens
cgaactaggaaagagcctaggagggagcctc

SEQ ID NO: 16441 - DNA, 32 bp, Homo sapiens
catgcatgtggatagacccccacgggccgtgg

SEQ ID NO: 16442 - DNA, 32 bp, Homo sapiens
agcctctcaagtagctgggattacagggcacc

SEQ ID NO: 16443 - DNA, 22 bp, Homo sapiens
ctgtacagtaccttgttgcaga

SEQ ID NO: 16444 - DNA, 32 bp, Homo sapiens
cacgcctatcttctctctctgctcctccttcc

SEQ ID NO: 16445 - DNA, 32 bp, Homo sapiens
gacactgggaggtcagcatgttccacaggtgt

SEQ ID NO: 16446 - DNA, 32 bp, Homo sapiens
ctcctgctgctgctgccgccacagctgcacct

SEQ ID NO: 16447 - DNA, 32 bp, Homo sapiens
gacatggtgccatcctcacaggcctagctcat

SEQ ID NO: 16448 - DNA, 32 bp, Homo sapiens
gaaattgttaaccaaggaaacagggtcagcct

SEQ ID NO: 16449 - DNA, 32 bp, Homo sapiens
cgctcttgtccaggctggagtataatggtgcg

SEQ ID NO: 16450 - DNA, 32 bp, Homo sapiens
gctctgtcaccaggctggagtgcagtggaggc

SEQ ID NO: 16451 - DNA, 32 bp, Homo sapiens
gaacctagaagaggaaaaggaatgtcaggctc

SEQ ID NO: 16452 - DNA, 32 bp, Homo sapiens
gcactgtcgcctaggctggagtgcaacagtgt

SEQ ID NO: 16453 - DNA, 32 bp, Homo sapiens
ggcagatcaagcaattctcttgcctcagcctc

SEQ ID NO: 16454 - DNA, 32 bp, Homo sapiens
ctactcgggaggctgaggcaggagaatcacta

SEQ ID NO: 16455 - DNA, 32 bp, Homo sapiens
gcaccctgtagctcctgctccctgtgacccca

SEQ ID NO: 16456 - DNA, 32 bp, Homo sapiens
tcttggtttggtccctagaaatggcagcctgc

SEQ ID NO: 16457 - DNA, 32 bp, Homo sapiens
acaaatttggaggtgagagctttgccagaccc

SEQ ID NO: 16458 - DNA, 25 bp, Homo sapiens
tcaccccctgtaatcccagcacttt

SEQ ID NO: 16459 - DNA, 32 bp, Homo sapiens
ctgtttggcccaggcctgggccatgacggatg

SEQ ID NO: 16460 - DNA, 32 bp, Homo sapiens
ttgagatggagtcttgctcttgtcgcccaggc

SEQ ID NO: 16461 - DNA, 22 bp, Homo sapiens
tgtggggtggggggagcgggga

SEQ ID NO: 16462 - DNA, 32 bp, Homo sapiens
agagggcctggagtgaggactgaacactgggg

SEQ ID NO: 16463 - DNA, 32 bp, Homo sapiens
gaatccgggaggcggagcttgcagcgagccgg

SEQ ID NO: 16464 - DNA, 32 bp, Homo sapiens
gaggctgggaggcagaggttgcagtgagctga

SEQ ID NO: 16465 - DNA, 32 bp, Homo sapiens
gtcatcaggagaggagaatgaggatgaggccc

SEQ ID NO: 16466 - DNA, 32 bp, Homo sapiens
ctgacctcaggtgatcctcccacctcggcctc

SEQ ID NO: 16467 - DNA, 32 bp, Homo sapiens
ggctcatgcctgtaatcccagcactttggtag

SEQ ID NO: 16468 - DNA, 32 bp, Homo sapiens
ggcagcgtgcacactcggatttgctacgtttc

SEQ ID NO: 16469 - DNA, 22 bp, Homo sapiens
tcacgcctataatctcagcact

SEQ ID NO: 16470 - DNA, 32 bp, Homo sapiens
aaagaccgaaggggagaaagttaaagaaatcg

SEQ ID NO: 16471 - DNA, 32 bp, Homo sapiens
tctgttgccccaggctggagtgcagtggtgtg

SEQ ID NO: 16472 - DNA, 32 bp, Homo sapiens
ctctgtcgcccaagctggagtacagtggtgca

SEQ ID NO: 16473 - DNA, 32 bp, Homo sapiens
gagaccgacggccgctggagtgcactggcatg

SEQ ID NO: 16474 - DNA, 32 bp, Homo sapiens
gggagtcaaaatgcttcctggtgccgggagtg

SEQ ID NO: 16475 - DNA, 32 bp, Homo sapiens
acctccgcctcccgggttcaagcgattcatct

SEQ ID NO: 16476 - DNA, 32 bp, Homo sapiens
gaactcaggtggcagaggttgcagtgagccga

SEQ ID NO: 16477 - DNA, 32 bp, Homo sapiens
tgcccacaggatcagtctgattcccaagctct

SEQ ID NO: 16478 - DNA, 32 bp, Homo sapiens
ttgtggccaagaggcttcctggcatccacccc

SEQ ID NO: 16479 - DNA, 32 bp, Homo sapiens
tcaccatgaggtttgcctttgtggaaaactcg

SEQ ID NO: 16480 - DNA, 32 bp, Homo sapiens
aaagaaccaacaacctcaactgcctactccaa

SEQ ID NO: 16481 - DNA, 32 bp, Homo sapiens
actgtatttgacaaaggaaactcttaaattat

SEQ ID NO: 16482 - DNA, 31 bp, Homo sapiens
gggttgaacgttgcaactagggtggagatca

SEQ ID NO: 16483 - DNA, 32 bp, Homo sapiens
gtaggcctttgttttccaatggtgctatattc

SEQ ID NO: 16484 - DNA, 32 bp, Homo sapiens
agcctcccaagtagctgggattacaggcatgg

SEQ ID NO: 16485 - DNA, 32 bp, Homo sapiens
ttgagacacagtttcgctcttattgcccaggc

SEQ ID NO: 16486 - DNA, 32 bp, Homo sapiens
taaatggccgtttttggaattacttgataaga

SEQ ID NO: 16487 - DNA, 32 bp, Homo sapiens
caaggtcattggagagaacttctgtatgggca

SEQ ID NO: 16488 - DNA, 32 bp, Homo sapiens
tacaataatggaagggaaagaaagaagacaaa

SEQ ID NO: 16489 - DNA, 32 bp, Homo sapiens
acaggagaaaagggagaaagcaaaaagttgaa

SEQ ID NO: 16490 - DNA, 32 bp, Homo sapiens
gcccccgcagaactggctgctgcgtgtgaact

SEQ ID NO: 16491 - DNA, 32 bp, Homo sapiens
gtctgttgcccaggctggagtgcagtggtgtg

SEQ ID NO: 16492 - DNA, 32 bp, Homo sapiens
agcctgtgtccaggctggggagcccgtgtctg

SEQ ID NO: 16493 - DNA, 32 bp, Homo sapiens
gtctgtcacccaggctggagtgcagtggtgca

SEQ ID NO: 16494 - DNA, 32 bp, Homo sapiens
actcagtgctttagttttaacaacagtaaatt

SEQ ID NO: 16495 - DNA, 32 bp, Homo sapiens
ttagcctggaggtcaaggctgcagtgagccat

SEQ ID NO: 16496 - DNA, 32 bp, Homo sapiens
cgccaaggcgcctccttcctgggcatcctgga

SEQ ID NO: 16497 - DNA, 28 bp, Homo sapiens
tccgcacccagtgctgccgctcgtgctc

SEQ ID NO: 16498 - DNA, 32 bp, Homo sapiens
cagaaggaaggtttagaaagaaaagaacactt

SEQ ID NO: 16499 - DNA, 32 bp, Homo sapiens
gactccatttgctattctcttctttctccccc

SEQ ID NO: 16500 - DNA, 32 bp, Homo sapiens
gaagggctggtttgaattttggtgctactatc

SEQ ID NO: 16501 - DNA, 32 bp, Homo sapiens
tttaaatcttcctgggtcccaaggaattagaa

SEQ ID NO: 16502 - DNA, 32 bp, Homo sapiens
cactttgggaagcagaggtggcaggatcattc

SEQ ID NO: 16503 - DNA, 32 bp, Homo sapiens
ttatttgggacttgagatttgcagtgatacca

SEQ ID NO: 16504 - DNA, 32 bp, Homo sapiens
gccactaggtattcttgctcccagaggctgaa

SEQ ID NO: 16505 - DNA, 24 bp, Homo sapiens
tcacacctataatcccagcccttt

SEQ ID NO: 16506 - DNA, 32 bp, Homo sapiens
gaggaggaaggaggatcactgtggaaatcgtc

SEQ ID NO: 16507 - DNA, 32 bp, Homo sapiens
agttgcctgaggacagcagtgcagttgacatg

SEQ ID NO: 16508 - DNA, 24 bp, Homo sapiens
tcacccttgtaatcccagcacttt

SEQ ID NO: 16509 - DNA, 25 bp, Homo sapiens
tcacacctgtaatccccagcacttt

SEQ ID NO: 16510 - DNA, 24 bp, Homo sapiens
tcacccctgtaatctcagcacttt

SEQ ID NO: 16511 - DNA, 21 bp, Homo sapiens
ggtggccgggtgtggtggctt

SEQ ID NO: 16512 - DNA, 32 bp, Homo sapiens
gctccccatcttctccttactgcatctcagcc

SEQ ID NO: 16513 - DNA, 24 bp, Homo sapiens
tcaaacctataatcccagcacttt

SEQ ID NO: 16514 - DNA, 32 bp, Homo sapiens
aaagccgggaggcaagtaggacagagagatga

SEQ ID NO: 16515 - DNA, 32 bp, Homo sapiens
ccgccccacagtgccctgcagttgccaggctc

SEQ ID NO: 16516 - DNA, 32 bp, Homo sapiens
actctgtcacccaggctggagtgcaatggcat

SEQ ID NO: 16517 - DNA, 32 bp, Homo sapiens
actctgttacccaggctagagtgtagtggcat

SEQ ID NO: 16518 - DNA, 32 bp, Homo sapiens
gctctgttgcccaggctggagtgcaatggcac

SEQ ID NO: 16519 - DNA, 32 bp, Homo sapiens
actctgtcacccaggctggagtacaatggcgt

SEQ ID NO: 16520 - DNA, 32 bp, Homo sapiens
aaactgccaaccacaggaaacagcctggcaaa

SEQ ID NO: 16521 - DNA, 32 bp, Homo sapiens
cattctgcctccattctgaccatttcaggggt

SEQ ID NO: 16522 - DNA, 32 bp, Homo sapiens
gctgaacagcttttcttccctgatctctcgga

SEQ ID NO: 16523 - DNA, 22 bp, Homo sapiens
ctgtgccaggccagagtgcagt

SEQ ID NO: 16524 - DNA, 22 bp, Homo sapiens
cgcccgagcccccagccccggg

SEQ ID NO: 16525 - DNA, 32 bp, Homo sapiens
ttaaagatagtgtccctgctgtggaaaacctg

SEQ ID NO: 16526 - DNA, 32 bp, Homo sapiens
catttgtgcccaggttgaggctatagtgagcc

SEQ ID NO: 16527 - DNA, 32 bp, Homo sapiens
ctttgtcgcccaggctggagcgcagtcccgca

SEQ ID NO: 16528 - DNA, 18 bp, Homo sapiens
gccatcaccatgtgagaa

SEQ ID NO: 16529 - DNA, 32 bp, Homo sapiens
gtctcaaactcctggcctcaagcaatcctccc

SEQ ID NO: 16530 - DNA, 28 bp, Homo sapiens
tggtggcccagggctgcctccttccctg

SEQ ID NO: 16531 - DNA, 32 bp, Homo sapiens
tgaggaaactgcactgttttattttaattcag

SEQ ID NO: 16532 - DNA, 32 bp, Homo sapiens
ctcctaccacccttattggagcactttgtact

SEQ ID NO: 16533 - DNA, 32 bp, Homo sapiens
gtggttgcctccatgctgttctcatcatagtg

SEQ ID NO: 16534 - DNA, 32 bp, Homo sapiens
tctcagcaccacctaacgcaccaccttgccct

SEQ ID NO: 16535 - DNA, 32 bp, Homo sapiens
ctgccatcttctctccccaccaccctttcaca

SEQ ID NO: 16536 - DNA, 32 bp, Homo sapiens
gccctgccgcccaggctagagtgcagtggcac

SEQ ID NO: 16537 - DNA, 32 bp, Homo sapiens
ggagcagacctctgtgggcactgtgaggcgga

SEQ ID NO: 16538 - DNA, 32 bp, Homo sapiens
gtaaagacggggtttcgccttgttgcccaggg

SEQ ID NO: 16539 - DNA, 24 bp, Homo sapiens
tggcacaatcaaggctcactgcag

SEQ ID NO: 16540 - DNA, 32 bp, Homo sapiens
gggcaccgcggaggctggagccgcaatggtgc

SEQ ID NO: 16541 - DNA, 32 bp, Homo sapiens
ctttgtcacccaggctggagtatagtggcaca

SEQ ID NO: 16542 - DNA, 32 bp, Homo sapiens
aaacctggaagaggaagaggaaagcaaaggag

SEQ ID NO: 16543 - DNA, 32 bp, Homo sapiens
ctctgttggccaggctggagtgcagtgttcga

SEQ ID NO: 16544 - DNA, 32 bp, Homo sapiens
ctctgttgcctaggctggagtgcagtggcgcg

SEQ ID NO: 16545 - DNA, 32 bp, Homo sapiens
ctttgtcgcccaggctggagtgcagtggcgtg

SEQ ID NO: 16546 - DNA, 32 bp, Homo sapiens
agcatgatgatggatggatggactggagctag

SEQ ID NO: 16547 - DNA, 32 bp, Homo sapiens
taggatgtgaggtgagcatgagcttgagctga

SEQ ID NO: 16548 - DNA, 32 bp, Homo sapiens
acagtgttgggcatctgctccccgtggacaca

SEQ ID NO: 16549 - DNA, 21 bp, Homo sapiens
gcacacctccccaacagaagc

SEQ ID NO: 16550 - DNA, 32 bp, Homo sapiens
tgccttggtaatcccttagataatgtggaaac

SEQ ID NO: 16551 - DNA, 32 bp, Homo sapiens
agcctcccgagtagcagggattaccggtgtgc

SEQ ID NO: 16552 - DNA, 32 bp, Homo sapiens
tcatagcatccctcagcactcgccaggtgcag

SEQ ID NO: 16553 - DNA, 23 bp, Homo sapiens
gtcacccaggctggagtgccgtg

SEQ ID NO: 16554 - DNA, 32 bp, Homo sapiens
tttctccccaaaaatacatcctagccttaatg

SEQ ID NO: 16555 - DNA, 32 bp, Homo sapiens
gattctagaacaggagaaataaaacagctatc

SEQ ID NO: 16556 - DNA, 24 bp, Homo sapiens
tggcacgatcacagctcactgcag

SEQ ID NO: 16557 - DNA, 21 bp, Homo sapiens
agcacagggggacatgcctgg

SEQ ID NO: 16558 - DNA, 32 bp, Homo sapiens
ctgcctggacatcagtctggaagctgtgcatt

SEQ ID NO: 16559 - DNA, 32 bp, Homo sapiens
tgcaaacacctgggaggtacccagaaaacagc

SEQ ID NO: 16560 - DNA, 32 bp, Homo sapiens
gaacccgggaggcggaggttgcagtgagcctg

SEQ ID NO: 16561 - DNA, 32 bp, Homo sapiens
tctttggggaggcaactaggatggtgtggccg

SEQ ID NO: 16562 - DNA, 32 bp, Homo sapiens
gtcttgcgcctgtactcccagcactttgggag

SEQ ID NO: 16563 - DNA, 32 bp, Homo sapiens
agtacagagcagtcaccatctgatcttcatca

SEQ ID NO: 16564 - DNA, 32 bp, Homo sapiens
gctctgttgctcaggctggattgcagtggcgt

SEQ ID NO: 16565 - DNA, 19 bp, Homo sapiens
ggtctcctgtcctcctgca

SEQ ID NO: 16566 - DNA, 32 bp, Homo sapiens
ctggggtcgcctgggccacaggcacagcagct

SEQ ID NO: 16567 - DNA, 32 bp, Homo sapiens
tggttctgcctgcacttactttgtaatgccac

SEQ ID NO: 16568 - DNA, 32 bp, Homo sapiens
gcgcctgcgcggagctggagtccggctgggcc

SEQ ID NO: 16569 - DNA, 21 bp, Homo sapiens
ctgaccaacatggtgagaccc

SEQ ID NO: 16570 - DNA, 32 bp, Homo sapiens
cggaaggtagaacttagaattcagaacttggg

SEQ ID NO: 16571 - DNA, 32 bp, Homo sapiens
acctccacctcctgggttcaagcaattctcca

SEQ ID NO: 16572 - DNA, 32 bp, Homo sapiens
atgttgaaacctaatccccaatgtgatggtat

SEQ ID NO: 16573 - DNA, 32 bp, Homo sapiens
tgctgaagggaagagaggttgcagctgagcaa

SEQ ID NO: 16574 - DNA, 32 bp, Homo sapiens
tgggattcaaacccgggagtgtctgctgccac

SEQ ID NO: 16575 - DNA, 32 bp, Homo sapiens
gtagcttcatcctatccggaggcacagcacat

SEQ ID NO: 16576 - DNA, 32 bp, Homo sapiens
ctaagctcaagtgatcctcccacctcagcctc

SEQ ID NO: 16577 - DNA, 32 bp, Homo sapiens
aaatagtacttttagcataagcactttctgtg

SEQ ID NO: 16578 - DNA, 32 bp, Homo sapiens
gctttgttgccaggctggagtgcagtggcgcg

SEQ ID NO: 16579 - DNA, 32 bp, Homo sapiens
tgattttatggaagtgggcgaaaacaatcaaa

SEQ ID NO: 16580 - DNA, 23 bp, Homo sapiens
tggcacgatcttggttcactgca

SEQ ID NO: 16581 - DNA, 32 bp, Homo sapiens
agcttcctgagtaggtgggattacaagcatgc

SEQ ID NO: 16582 - DNA, 32 bp, Homo sapiens
gaacctgggaggcagaagttgcagtgaaacaa

SEQ ID NO: 16583 - DNA, 32 bp, Homo sapiens
agccctctcatctcctggaaccatggccagca

SEQ ID NO: 16584 - DNA, 25 bp, Homo sapiens
cgcccccgccctgtccctccgaagg

SEQ ID NO: 16585 - DNA, 21 bp, Homo sapiens
tcatgcctgtaatccaacatt

SEQ ID NO: 16586 - DNA, 23 bp, Homo sapiens
tcggggcactgcaggggccgagc

SEQ ID NO: 16587 - DNA, 23 bp, Homo sapiens
tggggcaatctcggctcactgca

SEQ ID NO: 16588 - DNA, 23 bp, Homo sapiens
tggcgcaatctgggctcactgca

SEQ ID NO: 16589 - DNA, 32 bp, Homo sapiens
ctttgtcgcccaggctggagtgcagtggcacg

SEQ ID NO: 16590 - DNA, 32 bp, Homo sapiens
ctctgtcacctaggctggagtgcagtggcaca

SEQ ID NO: 16591 - DNA, 32 bp, Homo sapiens
tgggtgatggatcctggaatctctccatccct

SEQ ID NO: 16592 - DNA, 32 bp, Homo sapiens
gctaaacagccaagactggagcagtctctcac

SEQ ID NO: 16593 - DNA, 32 bp, Homo sapiens
ccaatgtggaacaaatggagtgatctgttatc

SEQ ID NO: 16594 - DNA, 32 bp, Homo sapiens
cttgctgctagagtgggaggagaaagatgtct

SEQ ID NO: 16595 - DNA, 32 bp, Homo sapiens
acctccgcctcccgggttcaagcaattctcct

SEQ ID NO: 16596 - DNA, 32 bp, Homo sapiens
tccttgttcaaaacatttaatcatcttaagca

SEQ ID NO: 16597 - DNA, 32 bp, Homo sapiens
tacagacatcttcctcctccctcatcccttcc

SEQ ID NO: 16598 - DNA, 32 bp, Homo sapiens
ggctgaggggtcgggggaagaaaacagatgac

SEQ ID NO: 16599 - DNA, 32 bp, Homo sapiens
cccaggctgcagctgctcagaagctccaggca

SEQ ID NO: 16600 - DNA, 32 bp, Homo sapiens
gactagctgctgctgctgctgctgctgcaaac

SEQ ID NO: 16601 - DNA, 32 bp, Homo sapiens
ctgcttcctcaagctcttctgctagtgccctg

SEQ ID NO: 16602 - DNA, 16 bp, Homo sapiens
agggtctgtccagccc

SEQ ID NO: 16603 - DNA, 32 bp, Homo sapiens
cgcccggagccagccgcgcagcatgcactggg

SEQ ID NO: 16604 - DNA, 17 bp, Homo sapiens
ggcccgagccactgcag

SEQ ID NO: 16605 - DNA, 32 bp, Homo sapiens
cctgggaaatgaggataaagaaaatcgagagt

SEQ ID NO: 16606 - DNA, 32 bp, Homo sapiens
agcataaaattcttaaaatatatttcagatat

SEQ ID NO: 16607 - DNA, 32 bp, Homo sapiens
tgctccttatgggctggggtgtaatgtgcaga

SEQ ID NO: 16608 - DNA, 32 bp, Homo sapiens
tgcctgttgccagactggagtgcagtggcacg

SEQ ID NO: 16609 - DNA, 32 bp, Homo sapiens
cacatgtacatcctggaagctgcccaaggtgt

SEQ ID NO: 16610 - DNA, 32 bp, Homo sapiens
ctctgttgcccaagctggggtgcagtggcacg

SEQ ID NO: 16611 - DNA, 23 bp, Homo sapiens
cccctgccctgctcctaagggta

SEQ ID NO: 16612 - DNA, 32 bp, Homo sapiens
cgtcatcaacatcacagaaggctgatcgatat

SEQ ID NO: 16613 - DNA, 32 bp, Homo sapiens
gaatagggctggggcagctcccagagaatgaa

SEQ ID NO: 16614 - DNA, 32 bp, Homo sapiens
aacccctctgcaggagcttctcctgccgccag

SEQ ID NO: 16615 - DNA, 32 bp, Homo sapiens
tgttcacatcttcgctctggccagcccattct

SEQ ID NO: 16616 - DNA, 32 bp, Homo sapiens
tcttgctgcccaggctggagtgcagtggctca

SEQ ID NO: 16617 - DNA, 32 bp, Homo sapiens
gctagttagatcatttgcatctctccaccatt

SEQ ID NO: 16618 - DNA, 32 bp, Homo sapiens
ggaaaaggagtcaggagccactgtgaggtgag

SEQ ID NO: 16619 - DNA, 32 bp, Homo sapiens
gtctcggactcctggcctcaagcaatcctctt

SEQ ID NO: 16620 - DNA, 28 bp, Homo sapiens
gggagcccaagtgcagtgcctggtgctg

SEQ ID NO: 16621 - DNA, 32 bp, Homo sapiens
agcctcctgagtagctgggactacaggagctc

SEQ ID NO: 16622 - DNA, 32 bp, Homo sapiens
gaacccaggaggaagaggttgcagtgagccaa

SEQ ID NO: 16623 - DNA, 32 bp, Homo sapiens
cgctccgggaggcccgggagcggcagtggaac

SEQ ID NO: 16624 - DNA, 24 bp, Homo sapiens
tcatacctgttataccagcacttt

SEQ ID NO: 16625 - DNA, 32 bp, Homo sapiens
tggctctacctgcagaaagctgcattttccaa

SEQ ID NO: 16626 - DNA, 32 bp, Homo sapiens
caggaggctgaggcaggagaattactttaacc

SEQ ID NO: 16627 - DNA, 32 bp, Homo sapiens
ctgctcgttcttgccgagggtgcagtggtggc

SEQ ID NO: 16628 - DNA, 32 bp, Homo sapiens
atcttagaactctttctgaagagaccttatca

SEQ ID NO: 16629 - DNA, 32 bp, Homo sapiens
tggtcgcttcttctccttggatttgttaagga

SEQ ID NO: 16630 - DNA, 32 bp, Homo sapiens
taacccgggaggtggaggttgcagtgagctga

SEQ ID NO: 16631 - DNA, 32 bp, Homo sapiens
catcaaaccaaatcaacgttgctgctaataca

SEQ ID NO: 16632 - DNA, 32 bp, Homo sapiens
aagaaaacaaaccattgcttatgctgttatat

SEQ ID NO: 16633 - DNA, 32 bp, Homo sapiens
agaacatccgtccgtccatctgcatctctgtc

SEQ ID NO: 16634 - DNA, 32 bp, Homo sapiens
gctctgtcgcccaggctggaatgcagttgtga

SEQ ID NO: 16635 - DNA, 32 bp, Homo sapiens
actctgtcatccaggctggagtgcagtggcac

SEQ ID NO: 16636 - DNA, 32 bp, Homo sapiens
gaatcctctttcctccccatttggccctgggc

SEQ ID NO: 16637 - DNA, 24 bp, Homo sapiens
caaaatgaaaacaaagcaaatgaa

SEQ ID NO: 16638 - DNA, 32 bp, Homo sapiens
agacccagtcacattggatgtgatctgtataa

SEQ ID NO: 16639 - DNA, 32 bp, Homo sapiens
ttcccacagcttgccccacaccaccttcacac

SEQ ID NO: 16640 - DNA, 32 bp, Homo sapiens
gtcttccccaaaattgatcactccgccttctc

SEQ ID NO: 16641 - DNA, 32 bp, Homo sapiens
tacctcaacacagttgcttttctgccttgtct

SEQ ID NO: 16642 - DNA, 32 bp, Homo sapiens
ttgagatggagtttcgctgttgtcacccaggc

SEQ ID NO: 16643 - DNA, 32 bp, Homo sapiens
tgtatttggaagcctctgaagagaccatgtct

SEQ ID NO: 16644 - DNA, 32 bp, Homo sapiens
tactcagactgttactctggtgacacaacctg

SEQ ID NO: 16645 - DNA, 32 bp, Homo sapiens
aaactccagccatcctggagttgatattcacc

SEQ ID NO: 16646 - DNA, 32 bp, Homo sapiens
gagcagagcctttgtctcaggagcaaaccagc

SEQ ID NO: 16647 - DNA, 23 bp, Homo sapiens
gatggggaggcctggctctggga

SEQ ID NO: 16648 - DNA, 32 bp, Homo sapiens
ccacattggccaggctggtctcaaatgaccct

SEQ ID NO: 16649 - DNA, 32 bp, Homo sapiens
tcttatagagtctcctagaatatttcattggc

SEQ ID NO: 16650 - DNA, 32 bp, Homo sapiens
ccatatcatcaaggagctgataatctagtgga

SEQ ID NO: 16651 - DNA, 32 bp, Homo sapiens
tgtctcctaagtgccctcagacagcagtgacg

SEQ ID NO: 16652 - DNA, 32 bp, Homo sapiens
acccttggtcttggcacccttctgccttatac

SEQ ID NO: 16653 - DNA, 24 bp, Homo sapiens
tcacgcccgtaatcccagggcttt

SEQ ID NO: 16654 - DNA, 32 bp, Homo sapiens
ctactcgggaggctgaggtgaaaggatcactt

SEQ ID NO: 16655 - DNA, 32 bp, Homo sapiens
ttggtcttgctgctgatatctgccagaaaagg

SEQ ID NO: 16656 - DNA, 32 bp, Homo sapiens
cctctgctgctgctgccaccgctgattccatc

SEQ ID NO: 16657 - DNA, 32 bp, Homo sapiens
tttggagccctctcttaagtcagaactctgtc

SEQ ID NO: 16658 - DNA, 32 bp, Homo sapiens
gctgtattgccagactggagtgcagtggcgtg

SEQ ID NO: 16659 - DNA, 32 bp, Homo sapiens
gggcgtcttggttgaatcttttgctacaaacc

SEQ ID NO: 16660 - DNA, 32 bp, Homo sapiens
gcccgctgcccaggctggccgccgccgtgccg

SEQ ID NO: 16661 - DNA, 32 bp, Homo sapiens
ccaggagggaggcaggggaggggtgcggcggt

SEQ ID NO: 16662 - DNA, 28 bp, Homo sapiens
gttttcccaagtggcattttcatctcgc

SEQ ID NO: 16663 - DNA, 32 bp, Homo sapiens
cacagcaggcctgtcagttctctcttaccttc

SEQ ID NO: 16664 - DNA, 32 bp, Homo sapiens
tcccccatgcccaggtgtggtgaagtgaatcc

SEQ ID NO: 16665 - DNA, 26 bp, Homo sapiens
catggcttccagaggacgagatcata

SEQ ID NO: 16666 - DNA, 25 bp, Homo sapiens
caggaaagaggcccccatccagccc

SEQ ID NO: 16667 - DNA, 31 bp, Homo sapiens
cagcacacaaccttgattaggaggggctggg

SEQ ID NO: 16668 - DNA, 32 bp, Homo sapiens
tttattttgagcaattctcctgcctcagcctc

SEQ ID NO: 16669 - DNA, 32 bp, Homo sapiens
ctttgttgcccaggctggagtgcggtggcgtg

SEQ ID NO: 16670 - DNA, 32 bp, Homo sapiens
tggaagatacacttttgtctttgctattatag

SEQ ID NO: 16671 - DNA, 32 bp, Homo sapiens
tggggctgggttctgtcttctacaggccaccc

SEQ ID NO: 16672 - DNA, 32 bp, Homo sapiens
ctttgttgcccagactggagtgcagtggcata

SEQ ID NO: 16673 - DNA, 32 bp, Homo sapiens
ccctgtcacccaggctggagtgcagtggtgtg

SEQ ID NO: 16674 - DNA, 32 bp, Homo sapiens
ctctgtcgcccaggctggactacaatggcacg

SEQ ID NO: 16675 - DNA, 32 bp, Homo sapiens
ctactcgggaggctgaggcaggataatcactt

SEQ ID NO: 16676 - DNA, 32 bp, Homo sapiens
atcggcctgaggctgggacattacatgaaatc

SEQ ID NO: 16677 - DNA, 32 bp, Homo sapiens
agcctcccgagtagctgggattacaggaggct

SEQ ID NO: 16678 - DNA, 32 bp, Homo sapiens
tttgcagaggcgtaggaatgaggctggacaga

SEQ ID NO: 16679 - DNA, 32 bp, Homo sapiens
ttgtcctcaagtgatcctcccaccttagcctc

SEQ ID NO: 16680 - DNA, 32 bp, Homo sapiens
ggctcctgcctgtgatcctagcactttgggag

SEQ ID NO: 16681 - DNA, 32 bp, Homo sapiens
gaggcataggttaccacccccaccccggcccg

SEQ ID NO: 16682 - DNA, 20 bp, Homo sapiens
gcccctgcccagaaccaagt

SEQ ID NO: 16683 - DNA, 24 bp, Homo sapiens
tcactcttgtaatcccaaaacttt

SEQ ID NO: 16684 - DNA, 32 bp, Homo sapiens
tgctacaatttccattacagagacatctgttg

SEQ ID NO: 16685 - DNA, 32 bp, Homo sapiens
tagttaagcacaaaggaaaatatttcaataaa

SEQ ID NO: 16686 - DNA, 32 bp, Homo sapiens
aggcccctctgggctgatcttgtgccattctt

SEQ ID NO: 16687 - DNA, 21 bp, Homo sapiens
ggaggcagccacaggcgagtg

SEQ ID NO: 16688 - DNA, 32 bp, Homo sapiens
ctctgtcacccaggctggagtgcaatggcgcg

SEQ ID NO: 16689 - DNA, 32 bp, Homo sapiens
ctctgtcacccaggctagagtgcagtggcgcg

SEQ ID NO: 16690 - DNA, 32 bp, Homo sapiens
ctctgtcacccagactagagtgcagtggcacg

SEQ ID NO: 16691 - DNA, 32 bp, Homo sapiens
ggctcatgcctgtaatcctagcactttggaag

SEQ ID NO: 16692 - DNA, 32 bp, Homo sapiens
aacctctgcctcctggttcaagcgattattgt

SEQ ID NO: 16693 - DNA, 32 bp, Homo sapiens
ggttcatgcctgtaatcccagcactttggaag

SEQ ID NO: 16694 - DNA, 32 bp, Homo sapiens
ggctcgtgcttgtaatcccagcactttgggag

SEQ ID NO: 16695 - DNA, 32 bp, Homo sapiens
ggctcatgcctgtgatcctagcactttgggag

SEQ ID NO: 16696 - DNA, 25 bp, Homo sapiens
tccaagcctgctgctggaaacctca

SEQ ID NO: 16697 - DNA, 32 bp, Homo sapiens
ccctgccctcgaggagctttcattctgatgga

SEQ ID NO: 16698 - DNA, 32 bp, Homo sapiens
atgccgcctcaagggtcttcaggggaggccag

SEQ ID NO: 16699 - DNA, 32 bp, Homo sapiens
tcttgttgcccaggctgaagtgcaatgttgtg

SEQ ID NO: 16700 - DNA, 32 bp, Homo sapiens
ctctgtcatccaggctggagtgcagtggcacg

SEQ ID NO: 16701 - DNA, 32 bp, Homo sapiens
ctctgtcatccaggttggagtgcagtggcatg

SEQ ID NO: 16702 - DNA, 32 bp, Homo sapiens
acctccacctcccaggttcaagcaattcttct

SEQ ID NO: 16703 - DNA, 28 bp, Homo sapiens
tctcattcctaagttgcctcattaattt

SEQ ID NO: 16704 - DNA, 32 bp, Homo sapiens
agggttgggttagaggtgagctggggccggag

SEQ ID NO: 16705 - DNA, 24 bp, Homo sapiens
gttttgacctgtatcctttattta

SEQ ID NO: 16706 - DNA, 32 bp, Homo sapiens
ggcgccttcctggagcgcggggagatgtaaag

SEQ ID NO: 16707 - DNA, 32 bp, Homo sapiens
caataatgactatttcaaaattgctaaaagat

SEQ ID NO: 16708 - DNA, 32 bp, Homo sapiens
acagcaacttcctgtagtgagcactttgtatg

SEQ ID NO: 16709 - DNA, 32 bp, Homo sapiens
acccaggcctggagctgggatgcaatgtaggc

SEQ ID NO: 16710 - DNA, 32 bp, Homo sapiens
ttaccctctgcagcttgtcatcccttccgtct

SEQ ID NO: 16711 - DNA, 20 bp, Homo sapiens
tcggaagacccctgggccca

SEQ ID NO: 16712 - DNA, 32 bp, Homo sapiens
gctgcatgacctatcagtatggtgctaatgtg

SEQ ID NO: 16713 - DNA, 24 bp, Homo sapiens
tccaggccctgcccgaccccatca

SEQ ID NO: 16714 - DNA, 27 bp, Homo sapiens
gggagatccacagctaagacaccggga

SEQ ID NO: 16715 - DNA, 32 bp, Homo sapiens
cttccacttgagttctctcttctcctgctgga

SEQ ID NO: 16716 - DNA, 32 bp, Homo sapiens
ctgggctgcccaggggtgtgatgtggagctgg

SEQ ID NO: 16717 - DNA, 32 bp, Homo sapiens
cctgtctatgcatctgatttttgctacagttt

SEQ ID NO: 16718 - DNA, 21 bp, Homo sapiens
cagggaagcaggggccaacct

SEQ ID NO: 16719 - DNA, 32 bp, Homo sapiens
agttctcttgtgaacacttcaaacatcgctaa

SEQ ID NO: 16720 - DNA, 32 bp, Homo sapiens
acctccgcctcctgggttcaagcgattgtcct

SEQ ID NO: 16721 - DNA, 32 bp, Homo sapiens
tcaaacgtcccaaaaggagaaatgctttctta

SEQ ID NO: 16722 - DNA, 32 bp, Homo sapiens
agcctcccgagtagctgggattacaggcatgt

SEQ ID NO: 16723 - DNA, 32 bp, Homo sapiens
agcctcctgagtagctgggattacaggcatgc

SEQ ID NO: 16724 - DNA, 32 bp, Homo sapiens
gtttataagacctctttcagcagatcacatca

SEQ ID NO: 16725 - DNA, 19 bp, Homo sapiens
gaggttctgccacatgccc

SEQ ID NO: 16726 - DNA, 32 bp, Homo sapiens
actaatggaagcgattctcccatgctcatgtg

SEQ ID NO: 16727 - DNA, 32 bp, Homo sapiens
gctatcccagttccccactgccagggaacccc

SEQ ID NO: 16728 - DNA, 32 bp, Homo sapiens
cactcaagatacttgccagtctctccagtgtg

SEQ ID NO: 16729 - DNA, 32 bp, Homo sapiens
gctgaggcagaactcactgggggtgggcagtt

SEQ ID NO: 16730 - DNA, 32 bp, Homo sapiens
agcctcctgagtagctgggattacagatgtat

SEQ ID NO: 16731 - DNA, 32 bp, Homo sapiens
aagtagttgcccaagggccagctcagtttatc

SEQ ID NO: 16732 - DNA, 32 bp, Homo sapiens
acctctgcctcccgggttcaagcaattaactg

SEQ ID NO: 16733 - DNA, 21 bp, Homo sapiens
tcacgcctgtaatcccaacac

SEQ ID NO: 16734 - DNA, 22 bp, Homo sapiens
taaatagactagtcatgtcctt

SEQ ID NO: 16735 - DNA, 32 bp, Homo sapiens
agcctcccgagtagctgggattataggcgagt

SEQ ID NO: 16736 - DNA, 21 bp, Homo sapiens
tcagaagggtggtgtgggccc

SEQ ID NO: 16737 - DNA, 20 bp, Homo sapiens
tcatacctgtaatcccagca

SEQ ID NO: 16738 - DNA, 21 bp, Homo sapiens
tcacgcctgtaatcccagact

SEQ ID NO: 16739 - DNA, 32 bp, Homo sapiens
gctctgtcacccaggctggagttatagtgacg

SEQ ID NO: 16740 - DNA, 32 bp, Homo sapiens
ttcttattgcccaggcttgagtgcaatgacct

SEQ ID NO: 16741 - DNA, 32 bp, Homo sapiens
gttctgttgcctgggctggagtgcagtggcat

SEQ ID NO: 16742 - DNA, 32 bp, Homo sapiens
ttccttgcctgagatcacctagaaaggaaccc

SEQ ID NO: 16743 - DNA, 32 bp, Homo sapiens
taaaaatatgaggtgacatctttggcaaccag

SEQ ID NO: 16744 - DNA, 32 bp, Homo sapiens
taatatagtaggggttgaagaaaacaaaatag

SEQ ID NO: 16745 - DNA, 32 bp, Homo sapiens
acgctggccctctccttccccgaacacagcac

SEQ ID NO: 16746 - DNA, 32 bp, Homo sapiens
ctgtctcctaacctgccggggtcattccccac

SEQ ID NO: 16747 - DNA, 32 bp, Homo sapiens
ggaaattgtttgacataacacagggttcaggg

SEQ ID NO: 16748 - DNA, 32 bp, Homo sapiens
tattattattgtttgtaaaacatggttcacat

SEQ ID NO: 16749 - DNA, 21 bp, Homo sapiens
cagggaagccgccaccggccc

SEQ ID NO: 16750 - DNA, 32 bp, Homo sapiens
gtggccgaacatgcctcataggcacagctgac

SEQ ID NO: 16751 - DNA, 32 bp, Homo sapiens
gctctgtcatccaggctggagtgcagtgatgc

SEQ ID NO: 16752 - DNA, 32 bp, Homo sapiens
tgcaacccaagtggccttatccgtgcagtggt

SEQ ID NO: 16753 - DNA, 32 bp, Homo sapiens
gatgtgctccagctttccagtgacatgtgacg

SEQ ID NO: 16754 - DNA, 24 bp, Homo sapiens
tcatgcctataatcctaacacttt

SEQ ID NO: 16755 - DNA, 32 bp, Homo sapiens
tcccaggctggggatggatgctctgaccacag

SEQ ID NO: 16756 - DNA, 32 bp, Homo sapiens
gcagttgaggggtgaaaaagaaaacaaacaaa

SEQ ID NO: 16757 - DNA, 32 bp, Homo sapiens
cgccttgcagaactgtcagcctgtggagttgt

SEQ ID NO: 16758 - DNA, 32 bp, Homo sapiens
ttgagatggagtttcactcttgtcaaccagat

SEQ ID NO: 16759 - DNA, 32 bp, Homo sapiens
taatatgctctgggctggagaaatgaaatcct

SEQ ID NO: 16760 - DNA, 32 bp, Homo sapiens
ttttagcacatccatatcttttctacgttgaa

SEQ ID NO: 16761 - DNA, 32 bp, Homo sapiens
cccacccgcatcctgagtggcgctgcagggct

SEQ ID NO: 16762 - DNA, 32 bp, Homo sapiens
atcttgttagagagcttttcactgtgaggaag

SEQ ID NO: 16763 - DNA, 32 bp, Homo sapiens
tacaatccaagtgcattcaacaagtgatatgg

SEQ ID NO: 16764 - DNA, 32 bp, Homo sapiens
taaaattgccccacctgctctagatggatctt

SEQ ID NO: 16765 - DNA, 23 bp, Homo sapiens
atcttgcagtgctgcaacctgga

SEQ ID NO: 16766 - DNA, 32 bp, Homo sapiens
ctggcctcaagtgatccacccacctcagcctc

SEQ ID NO: 16767 - DNA, 32 bp, Homo sapiens
gggagagcagctgaggccgtgtggaaaattag

SEQ ID NO: 16768 - DNA, 32 bp, Homo sapiens
ccgtggcctcaaggaagcttgtggctttggag

SEQ ID NO: 16769 - DNA, 32 bp, Homo sapiens
acagcctctgcaggccctgctcttgcctctta

SEQ ID NO: 16770 - DNA, 22 bp, Homo sapiens
cagaaggggcccactgagccca

SEQ ID NO: 16771 - DNA, 32 bp, Homo sapiens
ctctgtcacctaggctggagttgcagtggttt

SEQ ID NO: 16772 - DNA, 32 bp, Homo sapiens
aatccgcagcacttcgatcactgtgagagaac

SEQ ID NO: 16773 - DNA, 20 bp, Homo sapiens
cagggaagcttcctcggtct

SEQ ID NO: 16774 - DNA, 32 bp, Homo sapiens
agccccctgagtagctgggattacaggtgcct

SEQ ID NO: 16775 - DNA, 32 bp, Homo sapiens
agcctcctgagtagctgggactacaggtgcct

SEQ ID NO: 16776 - DNA, 32 bp, Homo sapiens
gcctcgtgcctgtgatcccagcactttgggag

SEQ ID NO: 16777 - DNA, 32 bp, Homo sapiens
ggctcatgcctgtaatcgcagcactttgggag

SEQ ID NO: 16778 - DNA, 32 bp, Homo sapiens
ggtgacaggcctgggcctctgcaactgccctg

SEQ ID NO: 16779 - DNA, 32 bp, Homo sapiens
gtaattgtaacctttcaaatgagttacgtgaa

SEQ ID NO: 16780 - DNA, 32 bp, Homo sapiens
gcctcatgcctgtaatcccagcactttgggag

SEQ ID NO: 16781 - DNA, 32 bp, Homo sapiens
gcctcatgcctgtagtcccagcactttggggg

SEQ ID NO: 16782 - DNA, 32 bp, Homo sapiens
agtgctgtgctgctgctggtctcctgatggct

SEQ ID NO: 16783 - DNA, 32 bp, Homo sapiens
tattcctgagttttactctgtgacacatttaa

SEQ ID NO: 16784 - DNA, 32 bp, Homo sapiens
actggtcggaagagagaaagaacagtttcagt

SEQ ID NO: 16785 - DNA, 32 bp, Homo sapiens
gatggaggcagtggctggagtgaatgaacggc

SEQ ID NO: 16786 - DNA, 32 bp, Homo sapiens
cccctttaccttgagttgatagcaatagagca

SEQ ID NO: 16787 - DNA, 32 bp, Homo sapiens
cagaaccagtatctgtcatggaactgaacatt

SEQ ID NO: 16788 - DNA, 32 bp, Homo sapiens
agaggccaaaaccaggcttcaggttcgggaag

SEQ ID NO: 16789 - DNA, 32 bp, Homo sapiens
cactctgctgcctaggctgagtgcagtggtgt

SEQ ID NO: 16790 - DNA, 32 bp, Homo sapiens
attctatcacccaggctggagtggagtggtat

SEQ ID NO: 16791 - DNA, 32 bp, Homo sapiens
ctaatgggaagaggaaaatgggaaacaatgca

SEQ ID NO: 16792 - DNA, 32 bp, Homo sapiens
ttctgaggcctggtttgctcttaattaatata

SEQ ID NO: 16793 - DNA, 32 bp, Homo sapiens
cggcttcctggtagctgggactagagatgtgt

SEQ ID NO: 16794 - DNA, 32 bp, Homo sapiens
gacattctcatgagtaaccttctgccttcact

SEQ ID NO: 16795 - DNA, 32 bp, Homo sapiens
ctgtactctgcagcctgccttcctagagttgg

SEQ ID NO: 16796 - DNA, 32 bp, Homo sapiens
gggccacatcttctgccccttctcagcctccc

SEQ ID NO: 16797 - DNA, 32 bp, Homo sapiens
gaggacgacatcctgacctgctgctgaggctg

SEQ ID NO: 16798 - DNA, 32 bp, Homo sapiens
agcacaccctgaatcacccctactacagcacg

SEQ ID NO: 16799 - DNA, 32 bp, Homo sapiens
aacttgggagcctcttgagagtgtacagcatc

SEQ ID NO: 16800 - DNA, 32 bp, Homo sapiens
tgcagctccagtgccctgagctcccagccaca

SEQ ID NO: 16801 - DNA, 32 bp, Homo sapiens
tttggtgtcattattccatcttctccataagt

SEQ ID NO: 16802 - DNA, 32 bp, Homo sapiens
aagcatcagggatgctaagtgcagtgatgagg

SEQ ID NO: 16803 - DNA, 32 bp, Homo sapiens
gccccagggccctacctcctggaatgctttcc

SEQ ID NO: 16804 - DNA, 32 bp, Homo sapiens
ggtttatcaagcaaagcttttcttcatttgaa

SEQ ID NO: 16805 - DNA, 32 bp, Homo sapiens
ccaggttcaagcaattcccctgcctcagcttc

SEQ ID NO: 16806 - DNA, 32 bp, Homo sapiens
cagatattccacctgtaatagcactttggaac

SEQ ID NO: 16807 - DNA, 32 bp, Homo sapiens
agagaattccttgagtctaaggcacaggccca

SEQ ID NO: 16808 - DNA, 32 bp, Homo sapiens
ttatgggcttaagaagaagaccaccttgtcta

SEQ ID NO: 16809 - DNA, 21 bp, Homo sapiens
tgtgaaggcagagtatgggga

SEQ ID NO: 16810 - DNA, 32 bp, Homo sapiens
ctatggtccacaggctggagggtgcatggaac

SEQ ID NO: 16811 - DNA, 32 bp, Homo sapiens
gctttgcccagtagttggaaagtgaactcgac

SEQ ID NO: 16812 - DNA, 32 bp, Homo sapiens
aaggaaagaagagaggaaagaaaggagggaag

SEQ ID NO: 16813 - DNA, 32 bp, Homo sapiens
ccctgaagcgtcaggctgggggcagtctggta

SEQ ID NO: 16814 - DNA, 32 bp, Homo sapiens
aattatcctagagtgaggacttctgcagctta

SEQ ID NO: 16815 - DNA, 32 bp, Homo sapiens
gccgcagggaggcagggatggcaaggcgtgaa

SEQ ID NO: 16816 - DNA, 32 bp, Homo sapiens
ttttaaaaattatttcaaatggaactgaaaga

SEQ ID NO: 16817 - DNA, 32 bp, Homo sapiens
gccactttctgcatggctcccaccgcagctga

SEQ ID NO: 16818 - DNA, 32 bp, Homo sapiens
catggcggcggaacggcgctgtggaagtatgc

SEQ ID NO: 16819 - DNA, 32 bp, Homo sapiens
gcctggcctcttctcccctctcttcccagcag

SEQ ID NO: 16820 - DNA, 32 bp, Homo sapiens
ccaggccaacttctccccgctgtctgaggaca

SEQ ID NO: 16821 - DNA, 32 bp, Homo sapiens
aaaaattaaggggagagaggaaaacaaaacca

SEQ ID NO: 16822 - DNA, 32 bp, Homo sapiens
taccagaccctgtcctggatgctgggatacaa

SEQ ID NO: 16823 - DNA, 32 bp, Homo sapiens
ggtaggtctgcagctagcctactccctttgga

SEQ ID NO: 16824 - DNA, 23 bp, Homo sapiens
tgcgaggagcctttcatccgaag

SEQ ID NO: 16825 - DNA, 32 bp, Homo sapiens
cttctgccagttctgtcaattgtcagtcagaa

SEQ ID NO: 16826 - DNA, 32 bp, Homo sapiens
tcctttgcagaacttcagggactgggagcaga

SEQ ID NO: 16827 - DNA, 32 bp, Homo sapiens
taagtgaagatgctcttccagagaccaccttc

SEQ ID NO: 16828 - DNA, 32 bp, Homo sapiens
ctgctcgggaggctgaggcaggagaatcactt

SEQ ID NO: 16829 - DNA, 32 bp, Homo sapiens
tcctggggtgagggggaatgagtgttcttgac

SEQ ID NO: 16830 - DNA, 32 bp, Homo sapiens
gtttgtatgctttggtttagtgcaatgtgtgg

SEQ ID NO: 16831 - DNA, 32 bp, Homo sapiens
gcttaaccaagagtgagaggatatgtcatgtt

SEQ ID NO: 16832 - DNA, 32 bp, Homo sapiens
tactgtgccttcatccccatcctgggccctga

SEQ ID NO: 16833 - DNA, 32 bp, Homo sapiens
aatgaatgaatggatggatgttttgcatgctc

SEQ ID NO: 16834 - DNA, 32 bp, Homo sapiens
ggctaggagttagaggaagagagtgactcaaa

SEQ ID NO: 16835 - DNA, 32 bp, Homo sapiens
atttaccaatgagacatcttcctaggaactgg

SEQ ID NO: 16836 - DNA, 32 bp, Homo sapiens
ctgctctgcaacctttctcttctcacgggtct

SEQ ID NO: 16837 - DNA, 32 bp, Homo sapiens
cctctgcccacctcttctcttctgcttccata

SEQ ID NO: 16838 - DNA, 32 bp, Homo sapiens
actcgtcaccccagctggagtgcagtggtgcg

SEQ ID NO: 16839 - DNA, 32 bp, Homo sapiens
cacccttgcacattttgttactgtgaaggact

SEQ ID NO: 16840 - DNA, 32 bp, Homo sapiens
ctgggctttcaccttgaagcatggtcagcagc

SEQ ID NO: 16841 - DNA, 28 bp, Homo sapiens
aataacccaagtgactcctttctagtga

SEQ ID NO: 16842 - DNA, 32 bp, Homo sapiens
cactctgttgccaggctggagtgcagtggcgc

SEQ ID NO: 16843 - DNA, 32 bp, Homo sapiens
gaacccgggatgcagaggttgcagtgagctga

SEQ ID NO: 16844 - DNA, 32 bp, Homo sapiens
cctcaacctgttgccctttcccatgagctggc

SEQ ID NO: 16845 - DNA, 21 bp, Homo sapiens
atgagatttaaattctgtggg

SEQ ID NO: 16846 - DNA, 32 bp, Homo sapiens
cctggttcaagcaattctcatgcctcagcctc

SEQ ID NO: 16847 - DNA, 32 bp, Homo sapiens
cacccacgccgccgcggccccacgctgggcga

SEQ ID NO: 16848 - DNA, 32 bp, Homo sapiens
ggtgagcgagtttcactctgatgcaacagaaa

SEQ ID NO: 16849 - DNA, 32 bp, Homo sapiens
gagttgcccaaaaccattacttttaaacgctg

SEQ ID NO: 16850 - DNA, 16 bp, Homo sapiens
cccctgtttcctggta

SEQ ID NO: 16851 - DNA, 32 bp, Homo sapiens
cagtgctgcccaggacctggaccgaatggggg

SEQ ID NO: 16852 - DNA, 32 bp, Homo sapiens
cactgtcgcccaggctggagtgcagtggcgtg

SEQ ID NO: 16853 - DNA, 32 bp, Homo sapiens
ttgatatggagttttgctcttgttgcccaggc

SEQ ID NO: 16854 - DNA, 28 bp, Homo sapiens
taaccttcaagtgctcctcttcatttga

SEQ ID NO: 16855 - DNA, 30 bp, Homo sapiens
ccaaaatgatttcttcaaagcccagacttg

SEQ ID NO: 16856 - DNA, 32 bp, Homo sapiens
gaacccgggtggcggcgcttgcagtgagctga

SEQ ID NO: 16857 - DNA, 32 bp, Homo sapiens
attatttgtgccacctgctgtggactgttttc

SEQ ID NO: 16858 - DNA, 22 bp, Homo sapiens
tcatgcctgtaatcccagcatt

SEQ ID NO: 16859 - DNA, 32 bp, Homo sapiens
ggcctcccaaagtgttgggattataggcatga

SEQ ID NO: 16860 - DNA, 32 bp, Homo sapiens
gaatttctggaagaaaggctgtggaagggcca

SEQ ID NO: 16861 - DNA, 32 bp, Homo sapiens
aagttctgaaggccatgacacctgccttgcct

SEQ ID NO: 16862 - DNA, 32 bp, Homo sapiens
acccatcctcttctccccgtactgcctcaacc

SEQ ID NO: 16863 - DNA, 23 bp, Homo sapiens
tcatgcctgtaatccgagcactt

SEQ ID NO: 16864 - DNA, 32 bp, Homo sapiens
gacaggatctcaggctggagtgcagtggcaca

SEQ ID NO: 16865 - DNA, 32 bp, Homo sapiens
tgaaggcagcccaaggtctcccagaggctcgg

SEQ ID NO: 16866 - DNA, 21 bp, Homo sapiens
ggtttgggggatgcctgggac

SEQ ID NO: 16867 - DNA, 32 bp, Homo sapiens
acttcttgcccaggctggagtacaatggtgcg

SEQ ID NO: 16868 - DNA, 32 bp, Homo sapiens
tcttgtcgcccaggctggaggttaatggcatg

SEQ ID NO: 16869 - DNA, 32 bp, Homo sapiens
ctgcccacctgccatagtatttgctactgaat

SEQ ID NO: 16870 - DNA, 32 bp, Homo sapiens
agcctcctgagtagctggaattacaggcgccc

SEQ ID NO: 16871 - DNA, 32 bp, Homo sapiens
agccttccgagtagctgggactacagtgcttc

SEQ ID NO: 16872 - DNA, 32 bp, Homo sapiens
atacggccaagtgccctgtgtgccgctggcag

SEQ ID NO: 16873 - DNA, 32 bp, Homo sapiens
cccactcactgcactggggtccttggggtttg

SEQ ID NO: 16874 - DNA, 32 bp, Homo sapiens
ctgggcttaagtgaccctcccacctcagtctc

SEQ ID NO: 16875 - DNA, 32 bp, Homo sapiens
ccaggttcaagcaattctcttgcctcggcctc

SEQ ID NO: 16876 - DNA, 32 bp, Homo sapiens
tgcaatgggatcgcctggaaagcctggagtcc

SEQ ID NO: 16877 - DNA, 20 bp, Homo sapiens
gcctataatcccagtacttt

SEQ ID NO: 16878 - DNA, 22 bp, Homo sapiens
gatgaggaaactgaagcttgga

SEQ ID NO: 16879 - DNA, 32 bp, Homo sapiens
gaacccgggaggcagaccttgcagtgagccaa

SEQ ID NO: 16880 - DNA, 32 bp, Homo sapiens
ccctcccttgcctcctgctcccatgggaaaca

SEQ ID NO: 16881 - DNA, 32 bp, Homo sapiens
attaattgtaccacatgctaatcctgaagaga

SEQ ID NO: 16882 - DNA, 32 bp, Homo sapiens
gaggtcactgaagactgtgattacatgcacct

SEQ ID NO: 16883 - DNA, 32 bp, Homo sapiens
agcctcctgagtagctgggattataggcatgc

SEQ ID NO: 16884 - DNA, 32 bp, Homo sapiens
actctgtcaccctggctggagtgcggtggcga

SEQ ID NO: 16885 - DNA, 32 bp, Homo sapiens
agcctcccgagtagctgggattacaggcatgc

SEQ ID NO: 16886 - DNA, 32 bp, Homo sapiens
agcctcctgagtagctgggatcataggcacgc

SEQ ID NO: 16887 - DNA, 32 bp, Homo sapiens
agcctcctgagtagctgggattacaggcatgt

SEQ ID NO: 16888 - DNA, 32 bp, Homo sapiens
agaagaggaagaggaaagaaaaggagtcaggg

SEQ ID NO: 16889 - DNA, 32 bp, Homo sapiens
ctggactcaagtgatccgcccacctcggcccc

SEQ ID NO: 16890 - DNA, 32 bp, Homo sapiens
agcttcctgactagctgggactactggtgtgc

SEQ ID NO: 16891 - DNA, 32 bp, Homo sapiens
aaaggtccagttctcagtaccatgtgagttaa

SEQ ID NO: 16892 - DNA, 32 bp, Homo sapiens
ttctcctctagggactcttcagtctcatttag

SEQ ID NO: 16893 - DNA, 24 bp, Homo sapiens
tcatgcctgtaatcccagtacttt

SEQ ID NO: 16894 - DNA, 32 bp, Homo sapiens
acctccgcctcccgggttcaagcaatcctccc

SEQ ID NO: 16895 - DNA, 32 bp, Homo sapiens
gaacccggcgggcagaggttgcagtaagcaga

SEQ ID NO: 16896 - DNA, 32 bp, Homo sapiens
gaacccggcaggcggaggttgcagtgagcgga

SEQ ID NO: 16897 - DNA, 32 bp, Homo sapiens
caaccagggaggcagaggttgcagtgagccga

SEQ ID NO: 16898 - DNA, 32 bp, Homo sapiens
aacttgatttaccaagacaagctgtgggctgt

SEQ ID NO: 16899 - DNA, 32 bp, Homo sapiens
taacttcactgcaattctgtttccctcatttg

SEQ ID NO: 16900 - DNA, 32 bp, Homo sapiens
cttcagtccctcaggctggcagctgtgctggt

SEQ ID NO: 16901 - DNA, 32 bp, Homo sapiens
gtcgtgctgctgctggaagccaacagcctccg

SEQ ID NO: 16902 - DNA, 32 bp, Homo sapiens
accatctcccactgtggctaccaccttccctt

SEQ ID NO: 16903 - DNA, 32 bp, Homo sapiens
accgtgtctgcagcacgcttccgtctccgcat

SEQ ID NO: 16904 - DNA, 32 bp, Homo sapiens
gaacccgggaggcggagttgcggtgagccgag

SEQ ID NO: 16905 - DNA, 32 bp, Homo sapiens
attaccatagacgactcctagaggacagtgct

SEQ ID NO: 16906 - DNA, 32 bp, Homo sapiens
tgacctggcaggcggaggttgcagtgagccga

SEQ ID NO: 16907 - DNA, 32 bp, Homo sapiens
aggctccggacgcagaggtggcagtggcacca

SEQ ID NO: 16908 - DNA, 32 bp, Homo sapiens
gctgaggctgggcagaggtgggtgagaagagg

SEQ ID NO: 16909 - DNA, 32 bp, Homo sapiens
aagcaaaattggtctctttagagaccaatttg

SEQ ID NO: 16910 - DNA, 32 bp, Homo sapiens
gggtgaaatcttctccccatgactatgttttc

SEQ ID NO: 16911 - DNA, 32 bp, Homo sapiens
tgctcgtcacccaggctggagtgcaattgtgc

SEQ ID NO: 16912 - DNA, 32 bp, Homo sapiens
gcaaaggggtgggggctgggtgcagtggctca

SEQ ID NO: 16913 - DNA, 32 bp, Homo sapiens
gtttagcattcctcaggctactgtgaaaacac

SEQ ID NO: 16914 - DNA, 32 bp, Homo sapiens
atggctgaactgggggcccactgtggagagct

SEQ ID NO: 16915 - DNA, 32 bp, Homo sapiens
ctctgtcacccaggctggagtgccatggcatc

SEQ ID NO: 16916 - DNA, 32 bp, Homo sapiens
tcttgttgcccaggctggagtgcaatggtgca

SEQ ID NO: 16917 - DNA, 32 bp, Homo sapiens
ctctgttgcccaggctggagtgcaatggcacg

SEQ ID NO: 16918 - DNA, 32 bp, Homo sapiens
ggttgcctggctacctgctcatgagggacttg

SEQ ID NO: 16919 - DNA, 32 bp, Homo sapiens
ttaggttccaggaacttcctgagaacacccga

SEQ ID NO: 16920 - DNA, 32 bp, Homo sapiens
actctgtctcccaggctgctggagtgcagtgg

SEQ ID NO: 16921 - DNA, 32 bp, Homo sapiens
aaagtcacaagggggcctgagtgcagtggctc

SEQ ID NO: 16922 - DNA, 32 bp, Homo sapiens
ctgctcgggaggctgaggcaggagaattgctt

SEQ ID NO: 16923 - DNA, 32 bp, Homo sapiens
catctatcaagcaacacagccccttatcccag

SEQ ID NO: 16924 - DNA, 32 bp, Homo sapiens
ctgtttcaaactaaagctcccacctcgaacat

SEQ ID NO: 16925 - DNA, 32 bp, Homo sapiens
ctgtgcctgacggatgggctgtagaatggggt

SEQ ID NO: 16926 - DNA, 32 bp, Homo sapiens
cacggaagcctatcaacggatgcctgtgattc

SEQ ID NO: 16927 - DNA, 32 bp, Homo sapiens
cagccttctctgcagtcccttctgccctgccg

SEQ ID NO: 16928 - DNA, 16 bp, Homo sapiens
gcccctgcccgaggtg

SEQ ID NO: 16929 - DNA, 32 bp, Homo sapiens
tgttgctgctgtatgcgttccattgtgggaca

SEQ ID NO: 16930 - DNA, 32 bp, Homo sapiens
cccaggcagctggacatctccaggaaaccagg

SEQ ID NO: 16931 - DNA, 24 bp, Homo sapiens
ctgtcatccaggctagagtgcagt

SEQ ID NO: 16932 - DNA, 32 bp, Homo sapiens
gacctctcagtcagactggggtgcaggacctg

SEQ ID NO: 16933 - DNA, 32 bp, Homo sapiens
tgagggaggacctgctggctgcagtgaggagc

SEQ ID NO: 16934 - DNA, 32 bp, Homo sapiens
actatgttgcccaggctggagtgcagtggtgc

SEQ ID NO: 16935 - DNA, 32 bp, Homo sapiens
ctggtttcaagcaactcttctgcctcagcatc

SEQ ID NO: 16936 - DNA, 32 bp, Homo sapiens
actgtgttgcccaggctggagtgcagtagtgc

SEQ ID NO: 16937 - DNA, 32 bp, Homo sapiens
tcctgttgtgcaggctgtagtgcagtggcacg

SEQ ID NO: 16938 - DNA, 32 bp, Homo sapiens
tggagtcttgttctgtcacccaggctggagtg

SEQ ID NO: 16939 - DNA, 32 bp, Homo sapiens
tttcattcagcagggtattttctgccttgttg

SEQ ID NO: 16940 - DNA, 32 bp, Homo sapiens
ctctgttgcccaggctggagtgcagtggcacg

SEQ ID NO: 16941 - DNA, 32 bp, Homo sapiens
ctctgtcgcccaggttggagtgcagtggcacg

SEQ ID NO: 16942 - DNA, 32 bp, Homo sapiens
ctctgtcgcccaggctggagtgcagtggcatg

SEQ ID NO: 16943 - DNA, 32 bp, Homo sapiens
ctacccgggaggctgaggcaggagaatggcgt

SEQ ID NO: 16944 - DNA, 32 bp, Homo sapiens
gattgttggcaggccagcctgcagtgacagtg

SEQ ID NO: 16945 - DNA, 32 bp, Homo sapiens
cattttgggaggcagaggcaggaggattgctt

SEQ ID NO: 16946 - DNA, 32 bp, Homo sapiens
gaaccctggaggcggaagttgcagtgagccga

SEQ ID NO: 16947 - DNA, 32 bp, Homo sapiens
tgtatgctagaaatagaaagaaaagaaaattg

SEQ ID NO: 16948 - DNA, 32 bp, Homo sapiens
ccgggttcaagcagttctcctgcctcagtctc

SEQ ID NO: 16949 - DNA, 32 bp, Homo sapiens
tactcatgcctgtaatcccagcactttgagag

SEQ ID NO: 16950 - DNA, 22 bp, Homo sapiens
cagaccacacccatacccaagc

SEQ ID NO: 16951 - DNA, 32 bp, Homo sapiens
tcagcgggcatctcctggagacaggcagacat

SEQ ID NO: 16952 - DNA, 32 bp, Homo sapiens
caaaagcttcttctcccccagtgctgatcttg

SEQ ID NO: 16953 - DNA, 32 bp, Homo sapiens
gaaccctggaggcagaggtggtagtgagccga

SEQ ID NO: 16954 - DNA, 32 bp, Homo sapiens
gaacccaggaggcagagcttgtagtgagccta

SEQ ID NO: 16955 - DNA, 32 bp, Homo sapiens
aggaggcggaggcagcggctggaggagcgcga

SEQ ID NO: 16956 - DNA, 32 bp, Homo sapiens
aacagactcctaaaaggagggtttctttcctg

SEQ ID NO: 16957 - DNA, 32 bp, Homo sapiens
agcctcccaagtagctgggattacaggcacaa

SEQ ID NO: 16958 - DNA, 32 bp, Homo sapiens
actccatcactcaggctggagtacagtgctga

SEQ ID NO: 16959 - DNA, 32 bp, Homo sapiens
gggttatattggagagccagtcttctgcggtt

SEQ ID NO: 16960 - DNA, 32 bp, Homo sapiens
tcgccgttgcccaggctggagtgcggtggcat

SEQ ID NO: 16961 - DNA, 32 bp, Homo sapiens
aaacaagcttaggcttctcccaacttaacaaa

SEQ ID NO: 16962 - DNA, 32 bp, Homo sapiens
agaccacagaaaagagaaagaaaaggaaaggc

SEQ ID NO: 16963 - DNA, 32 bp, Homo sapiens
gtttataagacaggagaaaagggagaaagcaa

SEQ ID NO: 16964 - DNA, 32 bp, Homo sapiens
gctggactgctgctgttcaggagccaccagag

SEQ ID NO: 16965 - DNA, 32 bp, Homo sapiens
gaacccgggaggcacaggttccagtgggccaa

SEQ ID NO: 16966 - DNA, 32 bp, Homo sapiens
gaacctgggatgtggaggttgcagtgagccaa

SEQ ID NO: 16967 - DNA, 32 bp, Homo sapiens
tctgacccaagtgccaaaggcagacgtgcttt

SEQ ID NO: 16968 - DNA, 32 bp, Homo sapiens
tttttcttttgttagaggagagcttgatgtga

SEQ ID NO: 16969 - DNA, 32 bp, Homo sapiens
agcccagggaggcagaggttgctgtaagttga

SEQ ID NO: 16970 - DNA, 32 bp, Homo sapiens
gaacctgggagttagaggttgcagtgagctga

SEQ ID NO: 16971 - DNA, 32 bp, Homo sapiens
agcctactgggtagctgggactacaggggtgc

SEQ ID NO: 16972 - DNA, 32 bp, Homo sapiens
actctgtcacctaggctggagtgcagtggtgc

SEQ ID NO: 16973 - DNA, 32 bp, Homo sapiens
gctctattgcccaggctggagtgcagtggctc

SEQ ID NO: 16974 - DNA, 22 bp, Homo sapiens
tcacacctgtgatcccagcact

SEQ ID NO: 16975 - DNA, 32 bp, Homo sapiens
taggagcgaggtgcacattgcaccttacatcc

SEQ ID NO: 16976 - DNA, 32 bp, Homo sapiens
ctggcttcaagcaatccttccactttggcctt

SEQ ID NO: 16977 - DNA, 32 bp, Homo sapiens
gtgagtctgtcaggagcttcagcctagctgat

SEQ ID NO: 16978 - DNA, 32 bp, Homo sapiens
acataccctgcagctctcagctggctgcagta

SEQ ID NO: 16979 - DNA, 17 bp, Homo sapiens
gcccctgctgtcccagg

SEQ ID NO: 16980 - DNA, 32 bp, Homo sapiens
tcttctcacccaggctggaatgcagtggcaca

SEQ ID NO: 16981 - DNA, 32 bp, Homo sapiens
atttgattagaatttgaaaataaatcacattt

SEQ ID NO: 16982 - DNA, 32 bp, Homo sapiens
gaacagaatttatgactccactgtggaaaatg

SEQ ID NO: 16983 - DNA, 32 bp, Homo sapiens
acacagcgcctccagtgggagtgcagttggat

SEQ ID NO: 16984 - DNA, 32 bp, Homo sapiens
ccctgccctctgcactaagcactttccaggca

SEQ ID NO: 16985 - DNA, 32 bp, Homo sapiens
tggcctcagatggatggatgtgtttggacgag

SEQ ID NO: 16986 - DNA, 32 bp, Homo sapiens
gctctgtcgcccaggctggagtgcagtgccgc

SEQ ID NO: 16987 - DNA, 32 bp, Homo sapiens
actctgtcacccagactggagtgcagtgccac

SEQ ID NO: 16988 - DNA, 32 bp, Homo sapiens
acattgctgttcactagattatcttaacaaat

SEQ ID NO: 16989 - DNA, 32 bp, Homo sapiens
attctgactcaaaattctcctaaacctccctg

SEQ ID NO: 16990 - DNA, 21 bp, Homo sapiens
ggcaggtttccaagagcaggg

SEQ ID NO: 16991 - DNA, 23 bp, Homo sapiens
ggtctgaggtcttgcttgggcca

SEQ ID NO: 16992 - DNA, 21 bp, Homo sapiens
tcagaagggaccttggcacag

SEQ ID NO: 16993 - DNA, 32 bp, Homo sapiens
ctctgtggcccaggctggagtgcagtggcgca

SEQ ID NO: 16994 - DNA, 32 bp, Homo sapiens
gaggacgccgaggcctggagtgggtggtagcc

SEQ ID NO: 16995 - DNA, 32 bp, Homo sapiens
tggggttgggatccttggaatatttcaataaa

SEQ ID NO: 16996 - DNA, 32 bp, Homo sapiens
tcctcaagtaccacctgctgctccaggaaatt

SEQ ID NO: 16997 - DNA, 32 bp, Homo sapiens
agtctcctcagtagctggggctttaggtgggc

SEQ ID NO: 16998 - DNA, 32 bp, Homo sapiens
gagcgccgtgttcttcagcctcagctggaagg

SEQ ID NO: 16999 - DNA, 32 bp, Homo sapiens
aatttggccactaacatctcccatggaattgt

SEQ ID NO: 17000 - DNA, 32 bp, Homo sapiens
gcgatgtactagctgctcacaagcctgttcct

SEQ ID NO: 17001 - DNA, 21 bp, Homo sapiens
tggtaacaggctgggtgcaat

SEQ ID NO: 17002 - DNA, 32 bp, Homo sapiens
gtgtggatgcttttcctggagcactttccaag

SEQ ID NO: 17003 - DNA, 32 bp, Homo sapiens
atgggagcaggaggagaagatacgagagcagg

SEQ ID NO: 17004 - DNA, 18 bp, Homo sapiens
ctcacccctactcgggca

SEQ ID NO: 17005 - DNA, 23 bp, Homo sapiens
tgacgcgatcttggttcactgca

SEQ ID NO: 17006 - DNA, 32 bp, Homo sapiens
actctgtctcccaggctggagttgcagtggtg

SEQ ID NO: 17007 - DNA, 32 bp, Homo sapiens
ctggcagggaggcacgcaggtactgtgaaaat

SEQ ID NO: 17008 - DNA, 28 bp, Homo sapiens
gcctcccaaagtgctgtattttcttatc

SEQ ID NO: 17009 - DNA, 32 bp, Homo sapiens
tgctggaggcctgggatggagttctgggctta

SEQ ID NO: 17010 - DNA, 32 bp, Homo sapiens
aggcttctgagtagctaggactatgggtacat

SEQ ID NO: 17011 - DNA, 32 bp, Homo sapiens
cctggaggcggtggctgggataaacgtgcacc

SEQ ID NO: 17012 - DNA, 32 bp, Homo sapiens
ctatcctccaaaacagagggagccattttata

SEQ ID NO: 17013 - DNA, 32 bp, Homo sapiens
ggtggcctttgtcacttccttctgccttccaa

SEQ ID NO: 17014 - DNA, 32 bp, Homo sapiens
ggaagaggaagaggaggaaggcgacggcaaca

SEQ ID NO: 17015 - DNA, 32 bp, Homo sapiens
aataatgcatatcagaatctttatatggaaga

SEQ ID NO: 17016 - DNA, 32 bp, Homo sapiens
ctctgttgccccagcttgagtgcagtggcgtg

SEQ ID NO: 17017 - DNA, 32 bp, Homo sapiens
ttgagacagagttttgctcttgtcacctaggc

SEQ ID NO: 17018 - DNA, 32 bp, Homo sapiens
gaggaggggtggcagaggattgtttggccagg

SEQ ID NO: 17019 - DNA, 32 bp, Homo sapiens
ttgcctctcaggatgacaaacaacagcggctc

SEQ ID NO: 17020 - DNA, 24 bp, Homo sapiens
tcacacctgtaatcccagtacttt

SEQ ID NO: 17021 - DNA, 32 bp, Homo sapiens
ttcccagaatccattccatttgtgattccatg

SEQ ID NO: 17022 - DNA, 32 bp, Homo sapiens
actctgtcactcaggctggagtgcagtggtat

SEQ ID NO: 17023 - DNA, 32 bp, Homo sapiens
ctcccaagagcctccaaggcgccattggcttc

SEQ ID NO: 17024 - DNA, 32 bp, Homo sapiens
cacctgtcctgtgcttctctttccttacttct

SEQ ID NO: 17025 - DNA, 19 bp, Homo sapiens
tgtgaggagggcgtgggga

SEQ ID NO: 17026 - DNA, 22 bp, Homo sapiens
gccaccagcctgacacccagaa

SEQ ID NO: 17027 - DNA, 32 bp, Homo sapiens
cccagccatctgattggtgacagggtcaaccc

SEQ ID NO: 17028 - DNA, 32 bp, Homo sapiens
gtcactccaaaccttgaaactgtcagggtcag

SEQ ID NO: 17029 - DNA, 32 bp, Homo sapiens
ctctgtctcccaggctggactgcagtggtgcg

SEQ ID NO: 17030 - DNA, 32 bp, Homo sapiens
cccagagcaatctagaatctttgagtgcttgg

SEQ ID NO: 17031 - DNA, 32 bp, Homo sapiens
caaacccagccttttgcgattatggcttgtgg

SEQ ID NO: 17032 - DNA, 32 bp, Homo sapiens
cttacagtttccattgccaacaacagccatcc

SEQ ID NO: 17033 - DNA, 32 bp, Homo sapiens
cctatccatcattaaaaggtttattatcagtg

SEQ ID NO: 17034 - DNA, 32 bp, Homo sapiens
tcagctctgagtagctgggattataggcatgc

SEQ ID NO: 17035 - DNA, 32 bp, Homo sapiens
ggaggttctacaacaggaaatcaggcctacag

SEQ ID NO: 17036 - DNA, 21 bp, Homo sapiens
tccttactgctgaacatcctg

SEQ ID NO: 17037 - DNA, 22 bp, Homo sapiens
ctgtggcccaggctgagagcag

SEQ ID NO: 17038 - DNA, 32 bp, Homo sapiens
ttaaaattttaacaagacagggctaagagcca

SEQ ID NO: 17039 - DNA, 32 bp, Homo sapiens
tggaggcaggggcagaggtgacgacagtgccc

SEQ ID NO: 17040 - DNA, 32 bp, Homo sapiens
agaggcctgaccccctgctcctggcctgaaat

SEQ ID NO: 17041 - DNA, 32 bp, Homo sapiens
tcctccacctcctgggttcaagtgattctcct

SEQ ID NO: 17042 - DNA, 32 bp, Homo sapiens
ctgggctcgagcaattctcccacctcagccta

SEQ ID NO: 17043 - DNA, 32 bp, Homo sapiens
gtcttgtttgccaggctgaggctgagttgcat

SEQ ID NO: 17044 - DNA, 32 bp, Homo sapiens
gaacccaggaggcagagtttgcagtgagccaa

SEQ ID NO: 17045 - DNA, 32 bp, Homo sapiens
ttattcctccctcatgagcacagggtcggggg

SEQ ID NO: 17046 - DNA, 32 bp, Homo sapiens
ataaattatcttctctctttgtattgggaacc

SEQ ID NO: 17047 - DNA, 32 bp, Homo sapiens
ttattttcaagcaaatatttatgacctcaaca

SEQ ID NO: 17048 - DNA, 18 bp, Homo sapiens
ctcaggctggagtgcaat

SEQ ID NO: 17049 - DNA, 32 bp, Homo sapiens
gggcccaggaggtggaggttgcagtgagccga

SEQ ID NO: 17050 - DNA, 32 bp, Homo sapiens
cttgtgtacatcctgtccctgccacatccata

SEQ ID NO: 17051 - DNA, 32 bp, Homo sapiens
tcttgtcgctcaggctggagtgccatggcgcg

SEQ ID NO: 17052 - DNA, 32 bp, Homo sapiens
cccctgtgtcctggcatttcagtctagacctt

SEQ ID NO: 17053 - DNA, 32 bp, Homo sapiens
taaacccaagaaatgatcctggaatacagtac

SEQ ID NO: 17054 - DNA, 32 bp, Homo sapiens
acctccaccttcctggttcaagggattctcct

SEQ ID NO: 17055 - DNA, 32 bp, Homo sapiens
gaactcgggtgggggaggttgcaatgagccga

SEQ ID NO: 17056 - DNA, 32 bp, Homo sapiens
taccaggaggagaccaggttgcagtggcgtaa

SEQ ID NO: 17057 - DNA, 32 bp, Homo sapiens
tctccagtcattaaatcagtgctgctgcatga

SEQ ID NO: 17058 - DNA, 32 bp, Homo sapiens
ggtgctcccgcagcttcgcctcctctcgtctt

SEQ ID NO: 17059 - DNA, 32 bp, Homo sapiens
aacatctctagtgcccttgcaagagcctttaa

SEQ ID NO: 17060 - DNA, 32 bp, Homo sapiens
gaatctaggaggcagaggttgcagtgaactga

SEQ ID NO: 17061 - DNA, 32 bp, Homo sapiens
aggaacagctcttcactcagccacaccccaca

SEQ ID NO: 17062 - DNA, 32 bp, Homo sapiens
gcctgaccaccatcctgccaccaccttctctt

SEQ ID NO: 17063 - DNA, 32 bp, Homo sapiens
cttaaaatctcgttttctcttcttccttcttt

SEQ ID NO: 17064 - DNA, 32 bp, Homo sapiens
caatcttgtgaatctgccacagctccaagatg

SEQ ID NO: 17065 - DNA, 32 bp, Homo sapiens
tacatcactcaacctgaacacaggggaggcag

SEQ ID NO: 17066 - DNA, 32 bp, Homo sapiens
tctgtacctcaaggcactgaagctggaggact

SEQ ID NO: 17067 - DNA, 32 bp, Homo sapiens
tctcatcacccaggctagagtgcagtggcaca

SEQ ID NO: 17068 - DNA, 32 bp, Homo sapiens
agggcagaggaagcagggtacagacaggagaa

SEQ ID NO: 17069 - DNA, 32 bp, Homo sapiens
cggtgtctgctgctgctgtccgagcttcacaa

SEQ ID NO: 17070 - DNA, 32 bp, Homo sapiens
cacttgttgcccaggctggagtgcaatggtac

SEQ ID NO: 17071 - DNA, 32 bp, Homo sapiens
gtctcaaactcctgggcacaagcaatccacct

SEQ ID NO: 17072 - DNA, 32 bp, Homo sapiens
tttctcctcttctcttcttgggacaggaataa

SEQ ID NO: 17073 - DNA, 32 bp, Homo sapiens
cgaaagcatcttctccttccgttcacggattt

SEQ ID NO: 17074 - DNA, 32 bp, Homo sapiens
ctgagctcaggcaatccgcccacctcagcctc

SEQ ID NO: 17075 - DNA, 32 bp, Homo sapiens
aagcggtgcccaggccggtggtgacaactggg

SEQ ID NO: 17076 - DNA, 32 bp, Homo sapiens
gccctgttgccaggctggaatgcagtggcgtg

SEQ ID NO: 17077 - DNA, 32 bp, Homo sapiens
acagagaatcagctggagcccagatttcaagt

SEQ ID NO: 17078 - DNA, 32 bp, Homo sapiens
cattctcatcgatacttcctggacatattttg

SEQ ID NO: 17079 - DNA, 32 bp, Homo sapiens
acctccgcctcctgggttcaagcaattctcct

SEQ ID NO: 17080 - DNA, 28 bp, Homo sapiens
ggctgccccagtgctgccacagtcccat

SEQ ID NO: 17081 - DNA, 32 bp, Homo sapiens
ctactcgggaggccgaggcaggagaattgctt

SEQ ID NO: 17082 - DNA, 32 bp, Homo sapiens
ctactcgggaggctgaggcaggagaattgttt

SEQ ID NO: 17083 - DNA, 32 bp, Homo sapiens
ctactcgggaggctgagacaggagaatctctt

SEQ ID NO: 17084 - DNA, 22 bp, Homo sapiens
gtcatccaagctggagtgcagt

SEQ ID NO: 17085 - DNA, 32 bp, Homo sapiens
ttgacaaactgcaccataggtgtttttagact

SEQ ID NO: 17086 - DNA, 32 bp, Homo sapiens
tggatgtggttagagggatgggctgaataggc

SEQ ID NO: 17087 - DNA, 32 bp, Homo sapiens
cttgatcacccaggctagagtgcagtggcgtg

SEQ ID NO: 17088 - DNA, 32 bp, Homo sapiens
ttcttagatatcttattcttagtaatactact

SEQ ID NO: 17089 - DNA, 32 bp, Homo sapiens
aaacccagaagaggaagaggaaagcaaaggag

SEQ ID NO: 17090 - DNA, 32 bp, Homo sapiens
gtctgtccccttcggaggagatgatgtagagg

SEQ ID NO: 17091 - DNA, 32 bp, Homo sapiens
ctggcctcaagtgatcctcccacctcagcgtc

SEQ ID NO: 17092 - DNA, 32 bp, Homo sapiens
gacagcctggagcttgggctgtggaagatttc

SEQ ID NO: 17093 - DNA, 32 bp, Homo sapiens
ggtgcctaccacacaggaaaccttgaagaaaa

SEQ ID NO: 17094 - DNA, 23 bp, Homo sapiens
tggcgtgatctcggttcactgca

SEQ ID NO: 17095 - DNA, 23 bp, Homo sapiens
tggcatgatctcagttcactgca

SEQ ID NO: 17096 - DNA, 32 bp, Homo sapiens
ccgtcgtatccctcggtccggcggcggcggcg

SEQ ID NO: 17097 - DNA, 32 bp, Homo sapiens
gggcccgggaggtggaggttgcagtgagctga

SEQ ID NO: 17098 - DNA, 32 bp, Homo sapiens
acctccgtctcctgggttcaagtgattcttct

SEQ ID NO: 17099 - DNA, 32 bp, Homo sapiens
catgggagaagaggggtataggacaaggggtg

SEQ ID NO: 17100 - DNA, 32 bp, Homo sapiens
agaagaagaagaggaagaaagaacagtagaaa

SEQ ID NO: 17101 - DNA, 32 bp, Homo sapiens
tcaggtggcagaggtgaaagaaaataatgtat

SEQ ID NO: 17102 - DNA, 32 bp, Homo sapiens
ctctgtcacctaggctacagtgcagtggtgtg

SEQ ID NO: 17103 - DNA, 32 bp, Homo sapiens
gtggttgctgcacttgaccactgtgaagactg

SEQ ID NO: 17104 - DNA, 24 bp, Homo sapiens
tcacgcctctaatcccagcacttt

SEQ ID NO: 17105 - DNA, 32 bp, Homo sapiens
acttccacctcctgggttcaagcaattctcct

SEQ ID NO: 17106 - DNA, 32 bp, Homo sapiens
gctttgttgcccaggctggagtgcggtggtgc

SEQ ID NO: 17107 - DNA, 32 bp, Homo sapiens
actttgtcgcccaggctggagtgcagtggtgt

SEQ ID NO: 17108 - DNA, 32 bp, Homo sapiens
gaacctgggagatggaggttgcagagagccaa

SEQ ID NO: 17109 - DNA, 32 bp, Homo sapiens
ggaggagagagaggagaagggaggcaggggag

SEQ ID NO: 17110 - DNA, 32 bp, Homo sapiens
agcctgccgagtagctgggactacaggtctaa

SEQ ID NO: 17111 - DNA, 32 bp, Homo sapiens
gctttgtcacccaggctggagtgcagtggtgt

SEQ ID NO: 17112 - DNA, 32 bp, Homo sapiens
ctctgtcgcgccagctggagtgcagtgccatg

SEQ ID NO: 17113 - DNA, 32 bp, Homo sapiens
ggggatgagccaggctggggacagtggggctg

SEQ ID NO: 17114 - DNA, 32 bp, Homo sapiens
agcctttctccaggtgggagtgcagtggcatg

SEQ ID NO: 17115 - DNA, 32 bp, Homo sapiens
tcctctgcctcccgggttcaagcaattctctg

SEQ ID NO: 17116 - DNA, 28 bp, Homo sapiens
gaattactcaaggctgcctctctgcaaa

SEQ ID NO: 17117 - DNA, 32 bp, Homo sapiens
ggcccctcctccattccagcatttcatctgcc

SEQ ID NO: 17118 - DNA, 32 bp, Homo sapiens
taagggtggcagggactggagtcagttggaga

SEQ ID NO: 17119 - DNA, 32 bp, Homo sapiens
gttgactggaggcggaggttgcagtgagccga

SEQ ID NO: 17120 - DNA, 32 bp, Homo sapiens
tctattcagcaaacactcagtgagacaaccat

SEQ ID NO: 17121 - DNA, 20 bp, Homo sapiens
gcaccttctcagccagcagc

SEQ ID NO: 17122 - DNA, 32 bp, Homo sapiens
gctggtaatgatgtatacctggcagctgaccg

SEQ ID NO: 17123 - DNA, 32 bp, Homo sapiens
tttgtgctgctgctgttattcaaagatcaaag

SEQ ID NO: 17124 - DNA, 32 bp, Homo sapiens
tcaaagaggagctgacacaagagaccacagtt

SEQ ID NO: 17125 - DNA, 32 bp, Homo sapiens
acctctcctcaaggactgctaagtcaggaaat

SEQ ID NO: 17126 - DNA, 32 bp, Homo sapiens
tcttgttgcccaggctatgggaagaaatgaaa

SEQ ID NO: 17127 - DNA, 32 bp, Homo sapiens
tcttgttgtccaggctggagtgcagtggcgcg

SEQ ID NO: 17128 - DNA, 32 bp, Homo sapiens
ggccgtgaagaagatagaagaaaacaacacgc

SEQ ID NO: 17129 - DNA, 32 bp, Homo sapiens
gaacccaggaggcggagcttgcagtgagccat

SEQ ID NO: 17130 - DNA, 28 bp, Homo sapiens
cccacccacagtgctgcactcctcctgc

SEQ ID NO: 17131 - DNA, 28 bp, Homo sapiens
tgttggccaagtgcttttcttcttgggc

SEQ ID NO: 17132 - DNA, 32 bp, Homo sapiens
ctgggctcaagtgatcctcccacctcagcttc

SEQ ID NO: 17133 - DNA, 32 bp, Homo sapiens
cggccacacttaacaggaagctcctaggcctc

SEQ ID NO: 17134 - DNA, 32 bp, Homo sapiens
gtttgaacagagcaggcttctgaggtctccaa

SEQ ID NO: 17135 - DNA, 32 bp, Homo sapiens
ggttttcctcaaggaacatttttgagctagaa

SEQ ID NO: 17136 - DNA, 32 bp, Homo sapiens
taaacagttttgttttgttttacttgaggggg

SEQ ID NO: 17137 - DNA, 32 bp, Homo sapiens
ctgctcatctgaccactgggcaccttagtgcc

SEQ ID NO: 17138 - DNA, 32 bp, Homo sapiens
aaacaggcggcaggctggggttggtggggctt

SEQ ID NO: 17139 - DNA, 21 bp, Homo sapiens
cagggcattgtcctccagccc

SEQ ID NO: 17140 - DNA, 32 bp, Homo sapiens
cgagaccttgaaggagctttgcaagtagagaa

SEQ ID NO: 17141 - DNA, 32 bp, Homo sapiens
gtctcaaactcctgggctcaagcaatgtattg

SEQ ID NO: 17142 - DNA, 32 bp, Homo sapiens
cccgccgcgggtgcccttcggaaacgcgctga

SEQ ID NO: 17143 - DNA, 32 bp, Homo sapiens
ctacagtcacccagcttagagctccagtcccc

SEQ ID NO: 17144 - DNA, 32 bp, Homo sapiens
gaacctgggaggctgagcttgcagtgagctga

SEQ ID NO: 17145 - DNA, 32 bp, Homo sapiens
gtctcggactcctgggctcaagcaatctgccc

SEQ ID NO: 17146 - DNA, 32 bp, Homo sapiens
gccttcacctcccgggttcaagtgattcttct

SEQ ID NO: 17147 - DNA, 32 bp, Homo sapiens
caggctggagtgcggtggtgtgatcttggctc

SEQ ID NO: 17148 - DNA, 32 bp, Homo sapiens
actctgtgtctcaggctggagtacagtggtgc

SEQ ID NO: 17149 - DNA, 24 bp, Homo sapiens
catctgacttcaatatttgccaaa

SEQ ID NO: 17150 - DNA, 24 bp, Homo sapiens
tcaagcctgtaatcccagtacttt

SEQ ID NO: 17151 - DNA, 32 bp, Homo sapiens
aaagaagcagaaagagaaagaatttgcaacca

SEQ ID NO: 17152 - DNA, 24 bp, Homo sapiens
ctgacgcacaggctggagtgcagt

SEQ ID NO: 17153 - DNA, 32 bp, Homo sapiens
atccaacctcttggtgcttcagtttcctcatc

SEQ ID NO: 17154 - DNA, 32 bp, Homo sapiens
agagaacatcttctcagaatcaggtctaatta

SEQ ID NO: 17155 - DNA, 23 bp, Homo sapiens
tcacgcctgtaatccaagcactt

SEQ ID NO: 17156 - DNA, 32 bp, Homo sapiens
aggaggccagttctgaaaggcgagcagaactc

SEQ ID NO: 17157 - DNA, 24 bp, Homo sapiens
ctgcagagaatggaaacgtgggaa

SEQ ID NO: 17158 - DNA, 32 bp, Homo sapiens
cagcttcctaaccttgaggggccagagaacaa

SEQ ID NO: 17159 - DNA, 23 bp, Homo sapiens
gcttggacttttctgacttcccc

SEQ ID NO: 17160 - DNA, 32 bp, Homo sapiens
cattcagaaggggaaaattgaaaacaacaaaa

SEQ ID NO: 17161 - DNA, 32 bp, Homo sapiens
aacaaaagaagaagaaaaagaaaaacaaccac

SEQ ID NO: 17162 - DNA, 32 bp, Homo sapiens
caactctttctgttctttctggcagctatctt

SEQ ID NO: 17163 - DNA, 32 bp, Homo sapiens
tgtttaaagtgtcacccctcactgtgactgat

SEQ ID NO: 17164 - DNA, 32 bp, Homo sapiens
gctcttttgcccaggctggatggagtgcagtg

SEQ ID NO: 17165 - DNA, 32 bp, Homo sapiens
cccaaacatcacctttcattctggacctacca

SEQ ID NO: 17166 - DNA, 32 bp, Homo sapiens
ctggcctgaagcaatccgcccacctcagcctc

SEQ ID NO: 17167 - DNA, 32 bp, Homo sapiens
gccagaaggcctggctggctgtgacttaccat

SEQ ID NO: 17168 - DNA, 23 bp, Homo sapiens
tggcgcgatctttgctcactgca

SEQ ID NO: 17169 - DNA, 23 bp, Homo sapiens
tggctcgatcttggctcactgca

SEQ ID NO: 17170 - DNA, 32 bp, Homo sapiens
acactccccaaaacacccctttccagttacaa

SEQ ID NO: 17171 - DNA, 32 bp, Homo sapiens
ggcctgaagcctaggctggagggttcagtcgg

SEQ ID NO: 17172 - DNA, 32 bp, Homo sapiens
gctctgtcacccaggctggagtgcactggctt

SEQ ID NO: 17173 - DNA, 32 bp, Homo sapiens
ttctccctccggatcgatgtgctgctgttaac

SEQ ID NO: 17174 - DNA, 32 bp, Homo sapiens
agccttccaaagtgctgggattactggcagga

SEQ ID NO: 17175 - DNA, 32 bp, Homo sapiens
atcatcagggattggccgatggagatgaaatg

SEQ ID NO: 17176 - DNA, 32 bp, Homo sapiens
tcacatgggcccaggctgagtgtgagtgagca

SEQ ID NO: 17177 - DNA, 32 bp, Homo sapiens
gggccaaggagattaagaagaaaacgactttc

SEQ ID NO: 17178 - DNA, 32 bp, Homo sapiens
tacaatatactttttattgagcactttgctgc

SEQ ID NO: 17179 - DNA, 32 bp, Homo sapiens
ggcctcctaaagtgctgggattacatgagcca

SEQ ID NO: 17180 - DNA, 32 bp, Homo sapiens
ataggccacatccttggggtcttcttattacc

SEQ ID NO: 17181 - DNA, 32 bp, Homo sapiens
agagattttgccttgagtatagcaataataaa

SEQ ID NO: 17182 - DNA, 32 bp, Homo sapiens
aggctgctggaaggagaaagaagagggtgagg

SEQ ID NO: 17183 - DNA, 32 bp, Homo sapiens
acctccgcctcccgggttcaagcgattctcct

SEQ ID NO: 17184 - DNA, 32 bp, Homo sapiens
cgtctaccttttgcccttattcaatagtggga

SEQ ID NO: 17185 - DNA, 32 bp, Homo sapiens
gaaccctggaagtggaggttgcagtgagcctg

SEQ ID NO: 17186 - DNA, 32 bp, Homo sapiens
acctttgcctcctgggttcaagcgattcttct

SEQ ID NO: 17187 - DNA, 32 bp, Homo sapiens
acctccgcctcccgggttcaagtgattctctt

SEQ ID NO: 17188 - DNA, 20 bp, Homo sapiens
acactgcccagcacaggggc

SEQ ID NO: 17189 - DNA, 32 bp, Homo sapiens
aggcttcatcttctccctgtaactgagatttc

SEQ ID NO: 17190 - DNA, 32 bp, Homo sapiens
gagcccgagaggtggaggttgcagtgagccga

SEQ ID NO: 17191 - DNA, 32 bp, Homo sapiens
ctctgttggccaggctggaatgcagtggcaca

SEQ ID NO: 17192 - DNA, 32 bp, Homo sapiens
ctcttgcatccctcctgcaggccagccatggc

SEQ ID NO: 17193 - DNA, 32 bp, Homo sapiens
gggccacctggcctttcagttacttgagtttg

SEQ ID NO: 17194 - DNA, 32 bp, Homo sapiens
tgacccaggaggcagaggttgcagtgagccaa

SEQ ID NO: 17195 - DNA, 32 bp, Homo sapiens
cctgaccttcacacctgctccccagagaagcc

SEQ ID NO: 17196 - DNA, 28 bp, Homo sapiens
ttgccaggtgatgctgcctctctgtgga

SEQ ID NO: 17197 - DNA, 32 bp, Homo sapiens
cagcctcgttggagagcagcaggtgctgtgcg

SEQ ID NO: 17198 - DNA, 24 bp, Homo sapiens
aatgttgacaattagattcttgga

SEQ ID NO: 17199 - DNA, 32 bp, Homo sapiens
aagccttgggtagaatgggaattctttaccct

SEQ ID NO: 17200 - DNA, 32 bp, Homo sapiens
cttctccttctctcttcgttgctgagcgacaa

SEQ ID NO: 17201 - DNA, 32 bp, Homo sapiens
tgatcatctaaccttacctgggtcctcagcta

SEQ ID NO: 17202 - DNA, 32 bp, Homo sapiens
ctctgtttccctgccagacaccacctttcccg

SEQ ID NO: 17203 - DNA, 32 bp, Homo sapiens
ttttctacaaccctgagcatttgctacatact

SEQ ID NO: 17204 - DNA, 32 bp, Homo sapiens
ttctgttgcctaggccagagtgcagtggcatg

SEQ ID NO: 17205 - DNA, 21 bp, Homo sapiens
gcacaatcacggctcactgca

SEQ ID NO: 17206 - DNA, 32 bp, Homo sapiens
ctctcttacccaagctggagtgcagtgacatg

SEQ ID NO: 17207 - DNA, 32 bp, Homo sapiens
ctccgtcacccaggctggagtgcagtggcaag

SEQ ID NO: 17208 - DNA, 32 bp, Homo sapiens
ctccgtagcccaggctggagtgcagtggcaca

SEQ ID NO: 17209 - DNA, 32 bp, Homo sapiens
agctctttgcccagctcctggggtgggagtgg

SEQ ID NO: 17210 - DNA, 32 bp, Homo sapiens
ctaaaaaccttcaaagacccagtctagccaaa

SEQ ID NO: 17211 - DNA, 32 bp, Homo sapiens
aaaacacatcttcttaacggatggtgacctat

SEQ ID NO: 17212 - DNA, 32 bp, Homo sapiens
taggtgttgcccaaattcagtgtcagtgaagt

SEQ ID NO: 17213 - DNA, 32 bp, Homo sapiens
gtgtaatagccttttgttaactaattttcttt

SEQ ID NO: 17214 - DNA, 32 bp, Homo sapiens
acagttctgctgctgtggcttcagctttggaa

SEQ ID NO: 17215 - DNA, 17 bp, Homo sapiens
gcttcccgccacccgaa

SEQ ID NO: 17216 - DNA, 32 bp, Homo sapiens
tgtgatgttcccacctgcttctgtagaaatgt

SEQ ID NO: 17217 - DNA, 28 bp, Homo sapiens
gaagcagcaagtgctgacatcatcacgg

SEQ ID NO: 17218 - DNA, 32 bp, Homo sapiens
ggcaccgggaggcggtggcggcggcggcggcg

SEQ ID NO: 17219 - DNA, 32 bp, Homo sapiens
gggaggtgaaggcagaggtggaggacatggac

SEQ ID NO: 17220 - DNA, 32 bp, Homo sapiens
ctgcctcaacatcttccgagtgggctacgatg

SEQ ID NO: 17221 - DNA, 32 bp, Homo sapiens
actgcagcctccacctcctgggctcaaagtga

SEQ ID NO: 17222 - DNA, 32 bp, Homo sapiens
tcactgtcacccaggccggagtgcagtggcac

SEQ ID NO: 17223 - DNA, 32 bp, Homo sapiens
acaagtgagtctcggctggagtgcagtggtgc

SEQ ID NO: 17224 - DNA, 32 bp, Homo sapiens
ctcactgttgccaggctggagtgcagtggcac

SEQ ID NO: 17225 - DNA, 32 bp, Homo sapiens
gatgtgatatgttatggatgtgatgtgttagt

SEQ ID NO: 17226 - DNA, 32 bp, Homo sapiens
gaaggaaatgttctcaaggtctcaggctattt

SEQ ID NO: 17227 - DNA, 32 bp, Homo sapiens
aaatgttttgtaactcaactggcctgcttcct

SEQ ID NO: 17228 - DNA, 31 bp, Homo sapiens
cccgagatgccggagttcctggaagacccct

SEQ ID NO: 17229 - DNA, 32 bp, Homo sapiens
actctgtcacccaggcgggagttaggtggcat

SEQ ID NO: 17230 - DNA, 32 bp, Homo sapiens
gccacagcctgagtgaatcctacaaatattac

SEQ ID NO: 17231 - DNA, 32 bp, Homo sapiens
gtgcccagcctatatctacttgagcctgtgtg

SEQ ID NO: 17232 - DNA, 31 bp, Homo sapiens
ggcttcaagaacacaaccttaggaccttggg

SEQ ID NO: 17233 - DNA, 32 bp, Homo sapiens
atttgctgctccctgaatcttctactgaacat

SEQ ID NO: 17234 - DNA, 32 bp, Homo sapiens
tttataccaccttgacccatttgctacattcc

SEQ ID NO: 17235 - DNA, 32 bp, Homo sapiens
ctgcaaatatgaagcctgaattttatgaaatt

SEQ ID NO: 17236 - DNA, 32 bp, Homo sapiens
agggaccacctgcaccaggcacttttctcctc

SEQ ID NO: 17237 - DNA, 32 bp, Homo sapiens
agcctcttgagtagctgggattacaggcatgc

SEQ ID NO: 17238 - DNA, 32 bp, Homo sapiens
gccctgtggctgggctggagtgcaatggcgcg

SEQ ID NO: 17239 - DNA, 28 bp, Homo sapiens
tggcccatgtttgctgcctctatctggt

SEQ ID NO: 17240 - DNA, 32 bp, Homo sapiens
gcagggatcagtggttctcccatatcaccatc

SEQ ID NO: 17241 - DNA, 32 bp, Homo sapiens
ctgggctcaagtgattctcccacctcagcctc

SEQ ID NO: 17242 - DNA, 32 bp, Homo sapiens
cgtgtttctgacgtttctcttccttgcctgga

SEQ ID NO: 17243 - DNA, 17 bp, Homo sapiens
tgagggaggagagggga

SEQ ID NO: 17244 - DNA, 23 bp, Homo sapiens
tcacgcccataatccagcacttt

SEQ ID NO: 17245 - DNA, 32 bp, Homo sapiens
taaacctttggtggctgggatatgatgggtta

SEQ ID NO: 17246 - DNA, 32 bp, Homo sapiens
agcatcccaagtagctgggattacaggcaccc

SEQ ID NO: 17247 - DNA, 21 bp, Homo sapiens
gtctccagcccaccctccgca

SEQ ID NO: 17248 - DNA, 32 bp, Homo sapiens
cctttgtctggatgcactcttctgaccttgct

SEQ ID NO: 17249 - DNA, 28 bp, Homo sapiens
tcctccctccttgctgcctcttcccacc

SEQ ID NO: 17250 - DNA, 28 bp, Homo sapiens
gcaagcatctaggctgcctcttcacttt

SEQ ID NO: 17251 - DNA, 32 bp, Homo sapiens
ggggagcaggggagggaaagaaaccaggcatc

SEQ ID NO: 17252 - DNA, 20 bp, Homo sapiens
gggccgcagtcagcgggcgc

SEQ ID NO: 17253 - DNA, 32 bp, Homo sapiens
agccaagcagtttctttcaaagaagccagcag

SEQ ID NO: 17254 - DNA, 32 bp, Homo sapiens
agctggagagggtgcgtttcactgtggggtgt

SEQ ID NO: 17255 - DNA, 32 bp, Homo sapiens
cttaagtcacccatcttccagtaagcagttta

SEQ ID NO: 17256 - DNA, 32 bp, Homo sapiens
agaagctgaaaaagctggagtgcaatggcacc

SEQ ID NO: 17257 - DNA, 32 bp, Homo sapiens
tcacacaggcctggggcaatctcttgacctca

SEQ ID NO: 17258 - DNA, 32 bp, Homo sapiens
agcctccggagtagctggggttacaggcacgg

SEQ ID NO: 17259 - DNA, 32 bp, Homo sapiens
ctttgcaaagcacaggcttaatttcattgctg

SEQ ID NO: 17260 - DNA, 28 bp, Homo sapiens
ggtggcatccaacctgcctcattcggcc

SEQ ID NO: 17261 - DNA, 32 bp, Homo sapiens
gggtctgcaagtgcccctcagcaggaacagct

SEQ ID NO: 17262 - DNA, 32 bp, Homo sapiens
gaacccgggaggtggaacttgcagtgagccga

SEQ ID NO: 17263 - DNA, 32 bp, Homo sapiens
ctacttgggaggcagaggcaggagaatcattt

SEQ ID NO: 17264 - DNA, 32 bp, Homo sapiens
gaacctggaaggtggagcttgcagtgagctga

SEQ ID NO: 17265 - DNA, 32 bp, Homo sapiens
catggaagaagagggggagagagttacaggtt

SEQ ID NO: 17266 - DNA, 32 bp, Homo sapiens
catcccccaagtgatgggaacaagggcccgcc

SEQ ID NO: 17267 - DNA, 32 bp, Homo sapiens
aaacccgggaggtggagcttgcagtgagccga

SEQ ID NO: 17268 - DNA, 32 bp, Homo sapiens
attggtcctgtggttggaaacagggtcaagta

SEQ ID NO: 17269 - DNA, 31 bp, Homo sapiens
gcacacagacagtgccctaggagggaaacag

SEQ ID NO: 17270 - DNA, 31 bp, Homo sapiens
ctcagcatcaacacaatttccaggggacctc

SEQ ID NO: 17271 - DNA, 32 bp, Homo sapiens
tcgcccaggctggagtgcagtggtagatcagg

SEQ ID NO: 17272 - DNA, 32 bp, Homo sapiens
ccacttgtgctgccgccatgtctctagtgatc

SEQ ID NO: 17273 - DNA, 32 bp, Homo sapiens
tgttttaccctatacatccacagggttttgac

SEQ ID NO: 17274 - DNA, 32 bp, Homo sapiens
taatacttaaggcactatggcacttagctttg

SEQ ID NO: 17275 - DNA, 32 bp, Homo sapiens
tcattaaatgttcaaaattgtagttttaaaaa

SEQ ID NO: 17276 - DNA, 32 bp, Homo sapiens
cttttgttgcccaggctggagtgcaatggcgc

SEQ ID NO: 17277 - DNA, 32 bp, Homo sapiens
gaacctgggtggtcgaggctgcagtgagccga

SEQ ID NO: 17278 - DNA, 32 bp, Homo sapiens
gaacccgggagttaaaggttgcagtgagccga

SEQ ID NO: 17279 - DNA, 32 bp, Homo sapiens
ctactcgggaggctgaggcaggagaatcgtct

SEQ ID NO: 17280 - DNA, 32 bp, Homo sapiens
tgatcagggaggcatagcagtgagagccatag

SEQ ID NO: 17281 - DNA, 32 bp, Homo sapiens
tctgtgactcccagtgttcaccaccttcctga

SEQ ID NO: 17282 - DNA, 32 bp, Homo sapiens
tctcaggttcaagcgatttttctgcctcagcc

SEQ ID NO: 17283 - DNA, 32 bp, Homo sapiens
gcgggagggggtcgagaaagaggaacgaggag

SEQ ID NO: 17284 - DNA, 32 bp, Homo sapiens
ctgtggctgctgctgactagggctgcatggga

SEQ ID NO: 17285 - DNA, 32 bp, Homo sapiens
tggctctcagctgcactcacagcaccagtgag

SEQ ID NO: 17286 - DNA, 22 bp, Homo sapiens
gggcctccaggatttgcctgca

SEQ ID NO: 17287 - DNA, 32 bp, Homo sapiens
ggtgtctgacccaccagcagtgcaatgggcag

SEQ ID NO: 17288 - DNA, 23 bp, Homo sapiens
taagcaaggcatgctgcagggaa

SEQ ID NO: 17289 - DNA, 21 bp, Homo sapiens
tggcacgatctcggctcactg

SEQ ID NO: 17290 - DNA, 32 bp, Homo sapiens
gcaaacccaacaagatgagacacttaaaccca

SEQ ID NO: 17291 - DNA, 32 bp, Homo sapiens
aggatgtgacatctgtgctgtgatctggatga

SEQ ID NO: 17292 - DNA, 32 bp, Homo sapiens
ctctgtctcccaggctggagtgcagtggcgta

SEQ ID NO: 17293 - DNA, 32 bp, Homo sapiens
ctggcctcaagcaatccttccatcttggcctc

SEQ ID NO: 17294 - DNA, 32 bp, Homo sapiens
agcgaaaggattagcagtgtgtggaaagaaca

SEQ ID NO: 17295 - DNA, 32 bp, Homo sapiens
tgatagcgaaggatagcaatgtggaaaatttg

SEQ ID NO: 17296 - DNA, 32 bp, Homo sapiens
acactgcatatggtccccatctggcctgagag

SEQ ID NO: 17297 - DNA, 23 bp, Homo sapiens
tcacaccttaatcccagcacttt

SEQ ID NO: 17298 - DNA, 32 bp, Homo sapiens
acctccatctcccgggttcaagcaattctcct

SEQ ID NO: 17299 - DNA, 24 bp, Homo sapiens
cagagaagccatgcgttccagcct

SEQ ID NO: 17300 - DNA, 21 bp, Homo sapiens
gccaccaaacccagcccagaa

SEQ ID NO: 17301 - DNA, 32 bp, Homo sapiens
aagctctgtcttctccctctgccctccaacag

SEQ ID NO: 17302 - DNA, 32 bp, Homo sapiens
gttatattgcctaggctggaatgcagtggtta

SEQ ID NO: 17303 - DNA, 32 bp, Homo sapiens
ggtcttgggttagagccaaaatggatttgagg

SEQ ID NO: 17304 - DNA, 32 bp, Homo sapiens
gtggttgctgaaggctggagtgggtgtggcaa

SEQ ID NO: 17305 - DNA, 32 bp, Homo sapiens
gttgggaggcctgggtccttttccccacgact

SEQ ID NO: 17306 - DNA, 32 bp, Homo sapiens
tgctctgttgccaagttaagtgcagtggtatg

SEQ ID NO: 17307 - DNA, 32 bp, Homo sapiens
tctctgttgcctgggctggagtgcagtggccc

SEQ ID NO: 17308 - DNA, 32 bp, Homo sapiens
ggctcatgcctgtaatcccagcactttggggg

SEQ ID NO: 17309 - DNA, 32 bp, Homo sapiens
ggctcatgcctgtagtcccagcactttgggag

SEQ ID NO: 17310 - DNA, 32 bp, Homo sapiens
ccacacagtttacaaacccagtatcatgtctg

SEQ ID NO: 17311 - DNA, 32 bp, Homo sapiens
attcaagggaggcaggcgctttggaagtttgt

SEQ ID NO: 17312 - DNA, 32 bp, Homo sapiens
agctctgcctcctgggttcaagcgattctctt

SEQ ID NO: 17313 - DNA, 32 bp, Homo sapiens
cgagtggcctgtgatggatgggtgctctgtgg

SEQ ID NO: 17314 - DNA, 32 bp, Homo sapiens
catggaatgcctagtgctaagtgcagtgtcct

SEQ ID NO: 17315 - DNA, 32 bp, Homo sapiens
tggaaagatggaggagaaaaagaaaaggaaga

SEQ ID NO: 17316 - DNA, 32 bp, Homo sapiens
ggccagcaaagaggaggggtccagagaacagc

SEQ ID NO: 17317 - DNA, 32 bp, Homo sapiens
tggcccaggaggcagaggttgcagtgagctga

SEQ ID NO: 17318 - DNA, 32 bp, Homo sapiens
tttcccagggggcagaggcaggggcgggaggg

SEQ ID NO: 17319 - DNA, 32 bp, Homo sapiens
agtgtctgggattggtagctctctccaactgc

SEQ ID NO: 17320 - DNA, 32 bp, Homo sapiens
gacattcttaacagggcggcagtctagtgttg

SEQ ID NO: 17321 - DNA, 24 bp, Homo sapiens
tcatacctatagtcccagcacttt

SEQ ID NO: 17322 - DNA, 32 bp, Homo sapiens
gtcaagaaatgagatggttcacttgactactg

SEQ ID NO: 17323 - DNA, 32 bp, Homo sapiens
gggctgaggttagaaggtgcagagcgtggaag

SEQ ID NO: 17324 - DNA, 32 bp, Homo sapiens
gggaaagacccaggctgcgggacgcggtgcag

SEQ ID NO: 17325 - DNA, 32 bp, Homo sapiens
gcttcctgcaggaggcgggattactatgacga

SEQ ID NO: 17326 - DNA, 32 bp, Homo sapiens
agcctcctaagtagctgggattacaggcgcgt

SEQ ID NO: 17327 - DNA, 32 bp, Homo sapiens
tttgctgatgttcttccaactcagttgagtga

SEQ ID NO: 17328 - DNA, 32 bp, Homo sapiens
ctactcgggaggctgaggcaggagaatggcct

SEQ ID NO: 17329 - DNA, 32 bp, Homo sapiens
attcaaagaactcagtctgataatctgcctcc

SEQ ID NO: 17330 - DNA, 32 bp, Homo sapiens
actaaagaaccaattcaaatggatgctgaaca

SEQ ID NO: 17331 - DNA, 32 bp, Homo sapiens
agaaggtctgcagcttcactcctgagccagcg

SEQ ID NO: 17332 - DNA, 32 bp, Homo sapiens
gcgttatatcttctcagcaactggccgcagtc

SEQ ID NO: 17333 - DNA, 32 bp, Homo sapiens
acgcggggaagaggaggcggaaaaggacgcaa

SEQ ID NO: 17334 - DNA, 23 bp, Homo sapiens
tggcaggatctcagctcactgca

SEQ ID NO: 17335 - DNA, 32 bp, Homo sapiens
cctacaagagccttcatccaggagcatccaca

SEQ ID NO: 17336 - DNA, 32 bp, Homo sapiens
tcaagctctgcagtttcctgtctggcaccctg

SEQ ID NO: 17337 - DNA, 32 bp, Homo sapiens
aaaaattacctgcaggtattttctttttatga

SEQ ID NO: 17338 - DNA, 32 bp, Homo sapiens
aacggacagaggcgagtggcaaacttcagacg

SEQ ID NO: 17339 - DNA, 32 bp, Homo sapiens
ctcttgtctcccaggctggagtgcagtgacac

SEQ ID NO: 17340 - DNA, 32 bp, Homo sapiens
catcttaggtattcctgctcccctgaagaatg

SEQ ID NO: 17341 - DNA, 32 bp, Homo sapiens
gctgagctgcaagacatcctggaattgggagc

SEQ ID NO: 17342 - DNA, 23 bp, Homo sapiens
ctgttgccagactggagtgcagt

SEQ ID NO: 17343 - DNA, 20 bp, Homo sapiens
caaaatgaaatccagtgaag

SEQ ID NO: 17344 - DNA, 32 bp, Homo sapiens
gcgggcgggaggctagctgttgtcgtggttgc

SEQ ID NO: 17345 - DNA, 32 bp, Homo sapiens
ggatttgaacaacatggttataattttcaaat

SEQ ID NO: 17346 - DNA, 32 bp, Homo sapiens
gcatgtgtgcccaggaccggggcagtcaccca

SEQ ID NO: 17347 - DNA, 32 bp, Homo sapiens
ccctgtcacccaggctggggtacggtggcatg

SEQ ID NO: 17348 - DNA, 32 bp, Homo sapiens
ctcacacatccctcgccactctgcacatggct

SEQ ID NO: 17349 - DNA, 32 bp, Homo sapiens
acctccgcctcctgggttgaagcgattcttgt

SEQ ID NO: 17350 - DNA, 32 bp, Homo sapiens
atggccacaagtgcccacagctggccccaggt

SEQ ID NO: 17351 - DNA, 32 bp, Homo sapiens
ccagaaatttctcctccatctgattttgaaca

SEQ ID NO: 17352 - DNA, 32 bp, Homo sapiens
ggaagattctgagacatttcgcctgagatata

SEQ ID NO: 17353 - DNA, 32 bp, Homo sapiens
aagagacggagtttcgctcttcttcccatgct

SEQ ID NO: 17354 - DNA, 32 bp, Homo sapiens
ctctccctgtgtcgcttaaacaacagtcctaa

SEQ ID NO: 17355 - DNA, 32 bp, Homo sapiens
ctccttgttttgctttcgatctggactgttct

SEQ ID NO: 17356 - DNA, 31 bp, Homo sapiens
tcacgtaagcagcacactaggaggcccaggc

SEQ ID NO: 17357 - DNA, 22 bp, Homo sapiens
atcttggccaatgtgacccgaa

SEQ ID NO: 17358 - DNA, 32 bp, Homo sapiens
caaataagagcctcttataaactccattcttg

SEQ ID NO: 17359 - DNA, 32 bp, Homo sapiens
agagctggagacaccatctcccaccgagagtc

SEQ ID NO: 17360 - DNA, 32 bp, Homo sapiens
gctggaagttcaggatgccaccaccttgaaca

SEQ ID NO: 17361 - DNA, 32 bp, Homo sapiens
ctctgctgcccaggctagagtgcagtggcgtg

SEQ ID NO: 17362 - DNA, 32 bp, Homo sapiens
gcaaccccagttctgctcctctccaggcaccc

SEQ ID NO: 17363 - DNA, 32 bp, Homo sapiens
cactgagctgctctgctcacctctagatgctc

SEQ ID NO: 17364 - DNA, 32 bp, Homo sapiens
ggttgcagaggctggccgctgcctggaagtgt

SEQ ID NO: 17365 - DNA, 32 bp, Homo sapiens
tgagcaggtgggcgtggatgtggatactgcct

SEQ ID NO: 17366 - DNA, 32 bp, Homo sapiens
gggaggcagaggttgcaatgagctgagatcgc

SEQ ID NO: 17367 - DNA, 32 bp, Homo sapiens
gagcccacagctgacttcatggtgctacaata

SEQ ID NO: 17368 - DNA, 20 bp, Homo sapiens
gtcgcccaggctggactgca

SEQ ID NO: 17369 - DNA, 24 bp, Homo sapiens
tcatgggtgttacctgctggccct

SEQ ID NO: 17370 - DNA, 32 bp, Homo sapiens
agcggttccagtgccctcaaagcaatctgtct

SEQ ID NO: 17371 - DNA, 32 bp, Homo sapiens
actctgtcacccaggctgtagtgcagtggcat

SEQ ID NO: 17372 - DNA, 32 bp, Homo sapiens
tacgccccagttctttcatcttggaattcttt

SEQ ID NO: 17373 - DNA, 17 bp, Homo sapiens
caggggagcccccaccc

SEQ ID NO: 17374 - DNA, 32 bp, Homo sapiens
acccaggctgccaggctggagtggagtggcat

SEQ ID NO: 17375 - DNA, 32 bp, Homo sapiens
actctgtcgcccagggtggagtgcggtggcac

SEQ ID NO: 17376 - DNA, 32 bp, Homo sapiens
gctctgtggcccaggctggagtgcagtggcac

SEQ ID NO: 17377 - DNA, 24 bp, Homo sapiens
ctgtggcccaggctggcgtgcagt

SEQ ID NO: 17378 - DNA, 32 bp, Homo sapiens
agaagcaagaattgcttttgaaggaaatggat

SEQ ID NO: 17379 - DNA, 32 bp, Homo sapiens
gctctgtcgcccaggctggagtgcagtggcag

SEQ ID NO: 17380 - DNA, 32 bp, Homo sapiens
ctgacctcaagcaatttgcccacctcgttctc

SEQ ID NO: 17381 - DNA, 32 bp, Homo sapiens
tggatttcaagcactttcacacttaacaaaat

SEQ ID NO: 17382 - DNA, 32 bp, Homo sapiens
ggctcatgcctgtaatcccagcactttcagag

SEQ ID NO: 17383 - DNA, 32 bp, Homo sapiens
atgtagctgatgtcactcaggagcacgagcga

SEQ ID NO: 17384 - DNA, 32 bp, Homo sapiens
aaggcttcttggaggaggagatgattgagctg

SEQ ID NO: 17385 - DNA, 32 bp, Homo sapiens
tctaggggcccaggccggcggcggcgatggcc

SEQ ID NO: 17386 - DNA, 32 bp, Homo sapiens
ccctgatgcccaggctgggtgcaggctctcat

SEQ ID NO: 17387 - DNA, 32 bp, Homo sapiens
ttgagacggagtttcacttttgttgcccaggc

SEQ ID NO: 17388 - DNA, 32 bp, Homo sapiens
ggtctgtcacccaggctggagtgcagtggtgc

SEQ ID NO: 17389 - DNA, 32 bp, Homo sapiens
gggccttcctgagacacattcagagaaggatc

SEQ ID NO: 17390 - DNA, 32 bp, Homo sapiens
gggaggtgcccaggtgggtggaccagtactcc

SEQ ID NO: 17391 - DNA, 32 bp, Homo sapiens
ccaccaaagctacaaacctaaaatgctgctgc

SEQ ID NO: 17392 - DNA, 32 bp, Homo sapiens
tcctgcaggcctgcggggatctctccccactt

SEQ ID NO: 17393 - DNA, 32 bp, Homo sapiens
agcctcctgagtagttgggactacaggcatat

SEQ ID NO: 17394 - DNA, 32 bp, Homo sapiens
ctggattcaaacaattctcctgcctcagcctc

SEQ ID NO: 17395 - DNA, 32 bp, Homo sapiens
ggcttatgcctgtaatcccagcactttgggtg

SEQ ID NO: 17396 - DNA, 32 bp, Homo sapiens
ggagctggatttgggagctctgcttgccgact

SEQ ID NO: 17397 - DNA, 32 bp, Homo sapiens
gaacccgggcagcggaggttgcagtgagccga

SEQ ID NO: 17398 - DNA, 32 bp, Homo sapiens
gaacctgggaggcagaggttgtggtgagctga

SEQ ID NO: 17399 - DNA, 32 bp, Homo sapiens
gaacctgggaggcagaggttgcagtgagccaa

SEQ ID NO: 17400 - DNA, 32 bp, Homo sapiens
gaacccgggaggcaaaggttgcagtgagctga

SEQ ID NO: 17401 - DNA, 24 bp, Homo sapiens
gtcacccaggctggagtgcaatga

SEQ ID NO: 17402 - DNA, 32 bp, Homo sapiens
agaaagaaagaaaagaaaagaaaatccctttt

SEQ ID NO: 17403 - DNA, 32 bp, Homo sapiens
gaacccaggaggcagaggttgcagtgagctga

SEQ ID NO: 17404 - DNA, 32 bp, Homo sapiens
tctttaggcaaaacaggaaacttcttaagtga

SEQ ID NO: 17405 - DNA, 32 bp, Homo sapiens
taagtgaaataaactggttcactagtagagaa

SEQ ID NO: 17406 - DNA, 32 bp, Homo sapiens
ctctgtcacctaggctagagtgcagtggtgcg

SEQ ID NO: 17407 - DNA, 32 bp, Homo sapiens
ggtggctggggtggcagctgatcatgtcagga

SEQ ID NO: 17408 - DNA, 32 bp, Homo sapiens
tgccatttgctgctgccgccaggaccagagca

SEQ ID NO: 17409 - DNA, 32 bp, Homo sapiens
tctccacatcttccttctctgaagtccaggta

SEQ ID NO: 17410 - DNA, 32 bp, Homo sapiens
agtaagatttttaaagacagaaagccacagga

SEQ ID NO: 17411 - DNA, 32 bp, Homo sapiens
ctgggttcaagaaatcctcccaccttgcctcc

SEQ ID NO: 17412 - DNA, 32 bp, Homo sapiens
gcggtggtctccattcagcaaaatctcatgta

SEQ ID NO: 17413 - DNA, 32 bp, Homo sapiens
taacccacagttctgtcacctaaaggtaactg

SEQ ID NO: 17414 - DNA, 32 bp, Homo sapiens
ttaagtcaacatcctttaaagctaagagtatg

SEQ ID NO: 17415 - DNA, 32 bp, Homo sapiens
tggtcagctaattgctttgacaacagcgcagt

SEQ ID NO: 17416 - DNA, 32 bp, Homo sapiens
gaacctgggaggtggaggttgcggtgagccaa

SEQ ID NO: 17417 - DNA, 32 bp, Homo sapiens
gaacccaggaggtggaggttgcggtgagctga

SEQ ID NO: 17418 - DNA, 32 bp, Homo sapiens
gaacctgggaggcggaggttgcagtgagtcga

SEQ ID NO: 17419 - DNA, 32 bp, Homo sapiens
gaacccaggaggcggaggttgcggtgagttga

SEQ ID NO: 17420 - DNA, 32 bp, Homo sapiens
gaacctaggaggcggaggttgcagtgagtcaa

SEQ ID NO: 17421 - DNA, 32 bp, Homo sapiens
gaactcaggaggcggaggttgcggtgagctga

SEQ ID NO: 17422 - DNA, 23 bp, Homo sapiens
atctccctccaggaagctgctgc

SEQ ID NO: 17423 - DNA, 32 bp, Homo sapiens
gaacctgggaggtggaggttgcagtgagccga

SEQ ID NO: 17424 - DNA, 32 bp, Homo sapiens
gaacccgggaggtggaggttgcagtgagctga

SEQ ID NO: 17425 - DNA, 32 bp, Homo sapiens
tctttcctctccaaagcctcagtctagcctgc

SEQ ID NO: 17426 - DNA, 32 bp, Homo sapiens
actcaatatgcagcttcctgtttcagtagggg

SEQ ID NO: 17427 - DNA, 32 bp, Homo sapiens
tgcgcattccttctccctggactttaccttac

SEQ ID NO: 17428 - DNA, 32 bp, Homo sapiens
tacagtaggccctgagccgactgtgaattcgg

SEQ ID NO: 17429 - DNA, 32 bp, Homo sapiens
cacaagtacgaacttagcaacactatattgag

SEQ ID NO: 17430 - DNA, 32 bp, Homo sapiens
gaatctcatccctcaactgagggccagggaca

SEQ ID NO: 17431 - DNA, 32 bp, Homo sapiens
cctctgtcatccaggctggagtgcagtggtgc

SEQ ID NO: 17432 - DNA, 32 bp, Homo sapiens
gctctatcacctaggctggagtgcagcggcat

SEQ ID NO: 17433 - DNA, 32 bp, Homo sapiens
ctctttagaatggaacacagaaaacaaacctt

SEQ ID NO: 17434 - DNA, 32 bp, Homo sapiens
ccatcaggggtagcgaggttgcaggagctggc

SEQ ID NO: 17435 - DNA, 32 bp, Homo sapiens
acacccccacattctctcctctggacccccag

SEQ ID NO: 17436 - DNA, 32 bp, Homo sapiens
cgccagcctggagtgagggagcaggatctggg

SEQ ID NO: 17437 - DNA, 32 bp, Homo sapiens
gagcccaggatgcagaggttgaagtgagccaa

SEQ ID NO: 17438 - DNA, 32 bp, Homo sapiens
catggtttgcatcctgcacaggcacaagcagc

SEQ ID NO: 17439 - DNA, 32 bp, Homo sapiens
catcgtttgcatcctgcacaggcacaagcggc

SEQ ID NO: 17440 - DNA, 32 bp, Homo sapiens
accccaaatcacactgcacacagggtccctga

SEQ ID NO: 17441 - DNA, 32 bp, Homo sapiens
agcctccccagtagctgggattacagtgttat

SEQ ID NO: 17442 - DNA, 32 bp, Homo sapiens
agacaagaattttccattctgttttcataact

SEQ ID NO: 17443 - DNA, 23 bp, Homo sapiens
tggtgcgatctcagctccctgca

SEQ ID NO: 17444 - DNA, 32 bp, Homo sapiens
gaactcgggaggcagaggttgtcatgagctga

SEQ ID NO: 17445 - DNA, 32 bp, Homo sapiens
gtctcaaactcctggcctcaagcaatcctcac

SEQ ID NO: 17446 - DNA, 32 bp, Homo sapiens
gctcctgtgctgctgagcagggcaaccagtag

SEQ ID NO: 17447 - DNA, 32 bp, Homo sapiens
agcacctctgcagcctctgctctgctgccttg

SEQ ID NO: 17448 - DNA, 32 bp, Homo sapiens
agcagaggggtcggaaagggaaaacaactacg

SEQ ID NO: 17449 - DNA, 32 bp, Homo sapiens
agcgagcagggctccccgccttaacttcctcc

SEQ ID NO: 17450 - DNA, 32 bp, Homo sapiens
ctctgtcactcaggctggaatgcagtggcgcg

SEQ ID NO: 17451 - DNA, 32 bp, Homo sapiens
aggctctttctgcagtcataccgcggacccaa

SEQ ID NO: 17452 - DNA, 32 bp, Homo sapiens
gaacccgggaggcggagtttgcagtgagccaa

SEQ ID NO: 17453 - DNA, 32 bp, Homo sapiens
gaacccgggaggcggaggttgcagttagccaa

SEQ ID NO: 17454 - DNA, 32 bp, Homo sapiens
ccgggctcaggtgattctcccgcctcagcacc

SEQ ID NO: 17455 - DNA, 32 bp, Homo sapiens
gcgtggagaagagggagggagcgagagcgaga

SEQ ID NO: 17456 - DNA, 32 bp, Homo sapiens
gtgcctgaaagtgcccttgggcacctcctcag

SEQ ID NO: 17457 - DNA, 32 bp, Homo sapiens
ggcaagccaagtgccctctctgaacctcagtt

SEQ ID NO: 17458 - DNA, 32 bp, Homo sapiens
aatgcttctagatgccttctctctccatctac

SEQ ID NO: 17459 - DNA, 32 bp, Homo sapiens
ccctaggctatacaagtctcagtctaggggaa

SEQ ID NO: 17460 - DNA, 32 bp, Homo sapiens
agtccccactcacggtgacaccaccttcctga

SEQ ID NO: 17461 - DNA, 32 bp, Homo sapiens
gattgctgccctaaaggagaatgctctttcct

SEQ ID NO: 17462 - DNA, 32 bp, Homo sapiens
gcgaaaagacggaaagaaagaaagaaaacgag

SEQ ID NO: 17463 - DNA, 32 bp, Homo sapiens
cctgccattccagaactggaccacagaaaagt

SEQ ID NO: 17464 - DNA, 32 bp, Homo sapiens
acctccgcctcctgggttccaacgattctcct

SEQ ID NO: 17465 - DNA, 28 bp, Homo sapiens
ggtggatagagtgctgcctctatccaca

SEQ ID NO: 17466 - DNA, 24 bp, Homo sapiens
tcacacctgcaatcccagcacttt

SEQ ID NO: 17467 - DNA, 24 bp, Homo sapiens
tcacgtctgtaatcccagcgcttt

SEQ ID NO: 17468 - DNA, 32 bp, Homo sapiens
cactcagagcaagatgagttgctgctattctt

SEQ ID NO: 17469 - DNA, 32 bp, Homo sapiens
caaacctctgcagcatctgctttattgccaaa

SEQ ID NO: 17470 - DNA, 32 bp, Homo sapiens
acgtggatgagctcctggacatggagagtgac

SEQ ID NO: 17471 - DNA, 32 bp, Homo sapiens
tccccatatcttctctcccccacctttatcga

SEQ ID NO: 17472 - DNA, 32 bp, Homo sapiens
cccccagtggatgtctaaaaccacagataata

SEQ ID NO: 17473 - DNA, 25 bp, Homo sapiens
cagagcgtgtcccagacatcacagc

SEQ ID NO: 17474 - DNA, 32 bp, Homo sapiens
acgcaggcagaactccttattgtgggacttga

SEQ ID NO: 17475 - DNA, 32 bp, Homo sapiens
gggaccaggagtagctgtcatttgatatgtat

SEQ ID NO: 17476 - DNA, 32 bp, Homo sapiens
tgcagaactgttcagtggtattacatgaaatg

SEQ ID NO: 17477 - DNA, 32 bp, Homo sapiens
gttttgtcgcccaggctggagtgcagtggcat

SEQ ID NO: 17478 - DNA, 32 bp, Homo sapiens
cctctcctctcttcctctcttctctcttcctc

SEQ ID NO: 17479 - DNA, 24 bp, Homo sapiens
tcatgcctgtaatcctagcatttt

SEQ ID NO: 17480 - DNA, 23 bp, Homo sapiens
tcatgcctgtaatccagcacttt

SEQ ID NO: 17481 - DNA, 32 bp, Homo sapiens
aaatggggatggctggggctctctccatcctc

SEQ ID NO: 17482 - DNA, 32 bp, Homo sapiens
tgcatgtagttgtcacttgcagctccatttcc

SEQ ID NO: 17483 - DNA, 32 bp, Homo sapiens
caaaatagttgaagcttaattacttgacttgc

SEQ ID NO: 17484 - DNA, 32 bp, Homo sapiens
tcttatcgcccaggctggggtgcaatggcgca

SEQ ID NO: 17485 - DNA, 32 bp, Homo sapiens
gagcagtcttccattccaactttagtttctgc

SEQ ID NO: 17486 - DNA, 32 bp, Homo sapiens
ttctttttgcctaggctggagtgcagtggtac

SEQ ID NO: 17487 - DNA, 32 bp, Homo sapiens
gtcatctgctgtggccccatctggccgctagc

SEQ ID NO: 17488 - DNA, 32 bp, Homo sapiens
gcaggtgggaggcacagattgtccgtgggagg

SEQ ID NO: 17489 - DNA, 32 bp, Homo sapiens
ttcgagcatccctcggataggccgggtgtcag

SEQ ID NO: 17490 - DNA, 32 bp, Homo sapiens
cctattttgaatgcagaaaacagggtctggga

SEQ ID NO: 17491 - DNA, 18 bp, Homo sapiens
acaaaaagaaatttctca

SEQ ID NO: 17492 - DNA, 32 bp, Homo sapiens
ggctgccaggacgcgagccactgaggagccgc

SEQ ID NO: 17493 - DNA, 32 bp, Homo sapiens
aataaagagccagcccccttccatttagtctc

SEQ ID NO: 17494 - DNA, 24 bp, Homo sapiens
tggcacaatctcggcccactgcag

SEQ ID NO: 17495 - DNA, 32 bp, Homo sapiens
ctcagaggaagaggaaagaaagaagaggaggg

SEQ ID NO: 17496 - DNA, 32 bp, Homo sapiens
actgacatgacttggctttctcatccagaaat

SEQ ID NO: 17497 - DNA, 32 bp, Homo sapiens
ctagtcagtttgcttgaaactagttcacctaa

SEQ ID NO: 17498 - DNA, 32 bp, Homo sapiens
atgctcagcccaggcattgagtgtgatgctga

SEQ ID NO: 17499 - DNA, 32 bp, Homo sapiens
gtttacctcccaagctggagtccagtggtgag

SEQ ID NO: 17500 - DNA, 32 bp, Homo sapiens
tttataagaagaggaagagacatcagtaatgc

SEQ ID NO: 17501 - DNA, 32 bp, Homo sapiens
gctgtttacctgcatttgttcacttttgttga

SEQ ID NO: 17502 - DNA, 32 bp, Homo sapiens
taggacctctgatatgaatgtgatctgagact

SEQ ID NO: 17503 - DNA, 32 bp, Homo sapiens
ctcttgtcggccaggctagagtgcagtggcgc

SEQ ID NO: 17504 - DNA, 30 bp, Homo sapiens
gagagatgaaggggcagcagaaaacagctg

SEQ ID NO: 17505 - DNA, 32 bp, Homo sapiens
ctactcgggaggctgaggcaggagagtgacgt

SEQ ID NO: 17506 - DNA, 24 bp, Homo sapiens
tggcatgatcataactcactgcag

SEQ ID NO: 17507 - DNA, 32 bp, Homo sapiens
ctctctcctctcctctctcttctcctcttctc

SEQ ID NO: 17508 - DNA, 32 bp, Homo sapiens
tttgatagccatctattcatctggatcatggg

SEQ ID NO: 17509 - DNA, 24 bp, Homo sapiens
ctgggcaacatggtgaaacccgtc

SEQ ID NO: 17510 - DNA, 32 bp, Homo sapiens
ggcagaggtagctgagggtagcatggcagagg

SEQ ID NO: 17511 - DNA, 23 bp, Homo sapiens
tggccccatctctgctcactgca

SEQ ID NO: 17512 - DNA, 32 bp, Homo sapiens
ctctgttgcccagactggagtgcagtggtgta

SEQ ID NO: 17513 - DNA, 32 bp, Homo sapiens
gcacggtgcccaggttggcctcctgctgggtg

SEQ ID NO: 17514 - DNA, 24 bp, Homo sapiens
ctgaccaacatgatgaaatgccat

SEQ ID NO: 17515 - DNA, 32 bp, Homo sapiens
ctctgtcacccaggctggagtatagtggtgtg

SEQ ID NO: 17516 - DNA, 32 bp, Homo sapiens
tgtgtctgcccaggctggctgagcgggtggat

SEQ ID NO: 17517 - DNA, 32 bp, Homo sapiens
acactgtcgccaggctggagtgcagtggtgcg

SEQ ID NO: 17518 - DNA, 32 bp, Homo sapiens
tccttgcttgcaatctcatctgattttgctag

SEQ ID NO: 17519 - DNA, 32 bp, Homo sapiens
tctctgccagccaggctggagtgcagtggcat

SEQ ID NO: 17520 - DNA, 32 bp, Homo sapiens
attctgatgcccaggttggggtgcagtggcac

SEQ ID NO: 17521 - DNA, 32 bp, Homo sapiens
cctgggttcaagtgattctccacctcagcctc

SEQ ID NO: 17522 - DNA, 32 bp, Homo sapiens
agcctcttgaatagctgggactagaagcatgc

SEQ ID NO: 17523 - DNA, 32 bp, Homo sapiens
ctctgtcacccagactggagtgcagtggtgcg

SEQ ID NO: 17524 - DNA, 32 bp, Homo sapiens
ctgtcctctgcagctccctctctggtcctggg

SEQ ID NO: 17525 - DNA, 32 bp, Homo sapiens
tcaatttatcttctccctggaattgggaccac

SEQ ID NO: 17526 - DNA, 24 bp, Homo sapiens
tcacacctataatcctaggacttt

SEQ ID NO: 17527 - DNA, 21 bp, Homo sapiens
agagaggcccggccgccggcc

SEQ ID NO: 17528 - DNA, 25 bp, Homo sapiens
acaggcacctgccaccacacccggc

SEQ ID NO: 17529 - DNA, 32 bp, Homo sapiens
tcctattcagcatcctggaacttatgtgggat

SEQ ID NO: 17530 - DNA, 32 bp, Homo sapiens
tggacaaaatggctggcttcaaaatatagtca

SEQ ID NO: 17531 - DNA, 32 bp, Homo sapiens
gtaattttatctaaattacagtgcagtttagt

SEQ ID NO: 17532 - DNA, 32 bp, Homo sapiens
aaatattgctcaggctggttgcaaactccttg

SEQ ID NO: 17533 - DNA, 32 bp, Homo sapiens
tcgggttcaagcaattgtctgcctcagcctcc

SEQ ID NO: 17534 - DNA, 32 bp, Homo sapiens
tgtggatatcttctctcatcttatgatttgtc

SEQ ID NO: 17535 - DNA, 32 bp, Homo sapiens
gaaccggggaggcggagcttgcagtgagccaa

SEQ ID NO: 17536 - DNA, 32 bp, Homo sapiens
gaacccaggaggctgaggttgcagtgagccag

SEQ ID NO: 17537 - DNA, 22 bp, Homo sapiens
acctgctgaccctggccttggc

SEQ ID NO: 17538 - DNA, 21 bp, Homo sapiens
tgtggtgtgcagaggtgggga

SEQ ID NO: 17539 - DNA, 32 bp, Homo sapiens
gctgggacctctctccccaactgccctgctct

SEQ ID NO: 17540 - DNA, 32 bp, Homo sapiens
ccggaaacctgagacatgctcaaggaagagca

SEQ ID NO: 17541 - DNA, 32 bp, Homo sapiens
aatgaccacatcctgaaaagggtgttgctaag

SEQ ID NO: 17542 - DNA, 24 bp, Homo sapiens
gtcccccaagctggagtacaatga

SEQ ID NO: 17543 - DNA, 32 bp, Homo sapiens
tcctcttcaagcagcaatccaacccagagcag

SEQ ID NO: 17544 - DNA, 32 bp, Homo sapiens
ctgggctcaagcaatcctcccaccttggtctc

SEQ ID NO: 17545 - DNA, 24 bp, Homo sapiens
ctgtcggccaggctggagtgcagt

SEQ ID NO: 17546 - DNA, 32 bp, Homo sapiens
ccatttctctgtgcccttttgacagctccagg

SEQ ID NO: 17547 - DNA, 32 bp, Homo sapiens
tgtgtttcttaatcttcccttctgccttgttc

SEQ ID NO: 17548 - DNA, 25 bp, Homo sapiens
tgcggggattggagagggatgggga

SEQ ID NO: 17549 - DNA, 32 bp, Homo sapiens
tgtgcctctctgggagaaaggagagaggataa

SEQ ID NO: 17550 - DNA, 32 bp, Homo sapiens
gacattgacttcctggatctttgcggccccag

SEQ ID NO: 17551 - DNA, 32 bp, Homo sapiens
gtgtgatggggtttcgcacttgttgcccaggc

SEQ ID NO: 17552 - DNA, 32 bp, Homo sapiens
gaaaggtctgcagcttcactcctgaagccagc

SEQ ID NO: 17553 - DNA, 32 bp, Homo sapiens
ctctgtcaccaaggctggagtgcagcggtgtg

SEQ ID NO: 17554 - DNA, 32 bp, Homo sapiens
cgagttgggactagggcttcaatttcacttct

SEQ ID NO: 17555 - DNA, 32 bp, Homo sapiens
gccatgttgcccaggctggtctgaagctgctg

SEQ ID NO: 17556 - DNA, 28 bp, Homo sapiens
tcatgcctataattaatcccagtacttt

SEQ ID NO: 17557 - DNA, 32 bp, Homo sapiens
ctctttggaaggcagaggcaggaggatcactt

SEQ ID NO: 17558 - DNA, 32 bp, Homo sapiens
gtcttgaactcctgggctcaagcaatcagccc

SEQ ID NO: 17559 - DNA, 21 bp, Homo sapiens
tgtgggcccaggagatggaga

SEQ ID NO: 17560 - DNA, 24 bp, Homo sapiens
tcacacctgtaatctcagcacttt

SEQ ID NO: 17561 - DNA, 24 bp, Homo sapiens
tcacacttgtaatcccagcacttt

SEQ ID NO: 17562 - DNA, 32 bp, Homo sapiens
actgtatatgaccttaatctttgtgcagcctg

SEQ ID NO: 17563 - DNA, 32 bp, Homo sapiens
aggtgtgtgctgctatgacatctctccagagc

SEQ ID NO: 17564 - DNA, 32 bp, Homo sapiens
acggtgtacctgctgctcagagcccccaaggc

SEQ ID NO: 17565 - DNA, 32 bp, Homo sapiens
gctctatcgcccaggctggagtgcagtggcgc

SEQ ID NO: 17566 - DNA, 32 bp, Homo sapiens
gctctgttgcccaggctggagtgcaatgacac

SEQ ID NO: 17567 - DNA, 32 bp, Homo sapiens
tcactctcacccaggctggagtgcagtggcac

SEQ ID NO: 17568 - DNA, 32 bp, Homo sapiens
gggcccaggcctggccctccacacttcattct

SEQ ID NO: 17569 - DNA, 32 bp, Homo sapiens
ttcgccgtctgcgtctcccccacgccgcctcg

SEQ ID NO: 17570 - DNA, 32 bp, Homo sapiens
agcattgtgttcttggcatgtgatctgggaaa

SEQ ID NO: 17571 - DNA, 32 bp, Homo sapiens
gccttcattaaccattattgtatgttggaaat

SEQ ID NO: 17572 - DNA, 32 bp, Homo sapiens
gtgttcaagcatggcttcctggcggcccaggc

SEQ ID NO: 17573 - DNA, 28 bp, Homo sapiens
gtcttttcccctgctgcctcactcccca

SEQ ID NO: 17574 - DNA, 32 bp, Homo sapiens
tctggtccatagagagcaaaacgctgtgctgc

SEQ ID NO: 17575 - DNA, 32 bp, Homo sapiens
cggtgggggaggcaggcggtggtgacaggaca

SEQ ID NO: 17576 - DNA, 32 bp, Homo sapiens
tttgtgtttacttaaactgtgctgctaagtag

SEQ ID NO: 17577 - DNA, 32 bp, Homo sapiens
tgtaacaaacccccatgacacacctttatgta

SEQ ID NO: 17578 - DNA, 32 bp, Homo sapiens
tttctcctcggaacatgacaatgaagctcttt

SEQ ID NO: 17579 - DNA, 32 bp, Homo sapiens
tttccctatcttctcccccacggtatcctaaa

SEQ ID NO: 17580 - DNA, 25 bp, Homo sapiens
aaggtacagtgtgtatgtgtgtatg

SEQ ID NO: 17581 - DNA, 32 bp, Homo sapiens
tgtgggcagcttctgagtggtgacacagcaag

SEQ ID NO: 17582 - DNA, 32 bp, Homo sapiens
attggacagctttcacaagtaacaggattagg

SEQ ID NO: 17583 - DNA, 32 bp, Homo sapiens
actgtgccattatgtaaatacaggttattccc

SEQ ID NO: 17584 - DNA, 20 bp, Homo sapiens
ctgaccaacatggtgaaact

SEQ ID NO: 17585 - DNA, 32 bp, Homo sapiens
gtctcggtgctgctgctgctgctcctggggct

SEQ ID NO: 17586 - DNA, 32 bp, Homo sapiens
cgctccatcaccaggctggagtgcagtggtgc

SEQ ID NO: 17587 - DNA, 32 bp, Homo sapiens
cagagtagttcaggctgggtggagcagtggga

SEQ ID NO: 17588 - DNA, 32 bp, Homo sapiens
tgttcttaggcattctatctttgctcaaattg

SEQ ID NO: 17589 - DNA, 32 bp, Homo sapiens
ccgggatcaagcaatcccacttcagcctcttg

SEQ ID NO: 17590 - DNA, 32 bp, Homo sapiens
cactctgtcaccaggctagagtgcagtggcac

SEQ ID NO: 17591 - DNA, 32 bp, Homo sapiens
gctctgtcacccgggctggagtgctgtggctt

SEQ ID NO: 17592 - DNA, 32 bp, Homo sapiens
aggtaagggagaggagaggattgatagagtgt

SEQ ID NO: 17593 - DNA, 32 bp, Homo sapiens
gtacactgaagcccctgctccacagagtagat

SEQ ID NO: 17594 - DNA, 32 bp, Homo sapiens
acctccatctccctggctcaagcaattctcct

SEQ ID NO: 17595 - DNA, 21 bp, Homo sapiens
tcacgtctgtaatcccagcac

SEQ ID NO: 17596 - DNA, 19 bp, Homo sapiens
ccacacagaaccaagcact

SEQ ID NO: 17597 - DNA, 32 bp, Homo sapiens
agaagaagaagaggaggaagagagggaaagag

SEQ ID NO: 17598 - DNA, 32 bp, Homo sapiens
ctccccgtttctctccccatcttggctgctgt

SEQ ID NO: 17599 - DNA, 31 bp, Homo sapiens
tcctcaccggcgcaggctaggagggggcggc

SEQ ID NO: 17600 - DNA, 21 bp, Homo sapiens
cacgtttaatcccagcacttt

SEQ ID NO: 17601 - DNA, 24 bp, Homo sapiens
ctgggagcacctgtctgttgcaga

SEQ ID NO: 17602 - DNA, 32 bp, Homo sapiens
ttagagagcttgtctttcaaggccaggttccc

SEQ ID NO: 17603 - DNA, 32 bp, Homo sapiens
gaccctgctcaaggaggctcatctggcctcct

SEQ ID NO: 17604 - DNA, 32 bp, Homo sapiens
acctccaccggtccaggtctttgctgctgtcc

SEQ ID NO: 17605 - DNA, 32 bp, Homo sapiens
agaatgccatctattaaaaacatggttaatat

SEQ ID NO: 17606 - DNA, 23 bp, Homo sapiens
tggcacaacctcggctcactgca

SEQ ID NO: 17607 - DNA, 32 bp, Homo sapiens
gccaccaggcctgctggtgtttggcttctcta

SEQ ID NO: 17608 - DNA, 32 bp, Homo sapiens
ttgggaggtggggaggaatgagagggtccagg

SEQ ID NO: 17609 - DNA, 32 bp, Homo sapiens
ctgtgttgctcaggctggagtgcagtggtgtg

SEQ ID NO: 17610 - DNA, 20 bp, Homo sapiens
gccgtctgtgccacccagag

SEQ ID NO: 17611 - DNA, 32 bp, Homo sapiens
ccctcaacctcctgggctcaagcaatcctcct

SEQ ID NO: 17612 - DNA, 32 bp, Homo sapiens
atctagaaggtatggggtagagcttgacaggg

SEQ ID NO: 17613 - DNA, 32 bp, Homo sapiens
ctccacacacccagagaaggagtggggtgggg

SEQ ID NO: 17614 - DNA, 32 bp, Homo sapiens
actcccgcaaacctgaatctcgagctacctat

SEQ ID NO: 17615 - DNA, 32 bp, Homo sapiens
agcttcctgagtagctgggaggacaggcatgc

SEQ ID NO: 17616 - DNA, 32 bp, Homo sapiens
agtcacccatgttctcaactggaagttggtcg

SEQ ID NO: 17617 - DNA, 32 bp, Homo sapiens
ctcttgttgcccaggctggagtgcagtggtgc

SEQ ID NO: 17618 - DNA, 32 bp, Homo sapiens
tgaaggtctgcagcttcactcctgaagccagc

SEQ ID NO: 17619 - DNA, 22 bp, Homo sapiens
caggagggagagagaggcagtg

SEQ ID NO: 17620 - DNA, 32 bp, Homo sapiens
gaattgggtttgtggcaaagagcttgacccag

SEQ ID NO: 17621 - DNA, 32 bp, Homo sapiens
ctgtgttgcccaggctggagtgcagtggcctg

SEQ ID NO: 17622 - DNA, 18 bp, Homo sapiens
gccaccaatccacccaga

SEQ ID NO: 17623 - DNA, 32 bp, Homo sapiens
ataaaggggaagtgaggagaatttctttcaag

SEQ ID NO: 17624 - DNA, 32 bp, Homo sapiens
tcttgtctccccggctggagtgcagtggcatg

SEQ ID NO: 17625 - DNA, 32 bp, Homo sapiens
cttaaaaacagtgtgcaaatggcagctagagg

SEQ ID NO: 17626 - DNA, 32 bp, Homo sapiens
gacctcaagagagggttcctggacctcccaca

SEQ ID NO: 17627 - DNA, 28 bp, Homo sapiens
ctccagaacccaactgcctcatcccgca

SEQ ID NO: 17628 - DNA, 28 bp, Homo sapiens
cattacctgaaggacgcctcatcatttc

SEQ ID NO: 17629 - DNA, 32 bp, Homo sapiens
gaacctgggaggcagtttgcagtgagctgaga

SEQ ID NO: 17630 - DNA, 32 bp, Homo sapiens
cctcagcttcgagccgaggtgcagtgagctgg

SEQ ID NO: 17631 - DNA, 32 bp, Homo sapiens
gggccccggaggtagaggttgcagtgagctga

SEQ ID NO: 17632 - DNA, 23 bp, Homo sapiens
tggcatgatctcggctcacggca

SEQ ID NO: 17633 - DNA, 18 bp, Homo sapiens
gccatcaccattccagag

SEQ ID NO: 17634 - DNA, 32 bp, Homo sapiens
acagtgccctgagacctctagagaaaagatgt

SEQ ID NO: 17635 - DNA, 32 bp, Homo sapiens
agagtcctccagagctgggatcccatgggcgc

SEQ ID NO: 17636 - DNA, 32 bp, Homo sapiens
agcctcctgagtagctgagattataggcctac

SEQ ID NO: 17637 - DNA, 32 bp, Homo sapiens
ctctgtcgcccagcctggagtgcagtggcacc

SEQ ID NO: 17638 - DNA, 32 bp, Homo sapiens
agcattttaaaccatttgtttttaaaattaat

SEQ ID NO: 17639 - DNA, 32 bp, Homo sapiens
tacgcaaactgcgcctgctcctgaaaagctct

SEQ ID NO: 17640 - DNA, 32 bp, Homo sapiens
tcaggaaagcctttatggtgtggctaaaggag

SEQ ID NO: 17641 - DNA, 24 bp, Homo sapiens
tcacgccggtaatcccagcacttt

SEQ ID NO: 17642 - DNA, 32 bp, Homo sapiens
cgctttgggaggcagaggcaggtggatcacct

SEQ ID NO: 17643 - DNA, 32 bp, Homo sapiens
ctctttcgccaaggctggagtgcagtggcacg

SEQ ID NO: 17644 - DNA, 32 bp, Homo sapiens
acgacagacccaggctggagtcttggctgtgc

SEQ ID NO: 17645 - DNA, 32 bp, Homo sapiens
ctttctctagaaaaagaaagaaaagaatgacc

SEQ ID NO: 17646 - DNA, 32 bp, Homo sapiens
agcctcctgagtagctgggtttacaggtgcct

SEQ ID NO: 17647 - DNA, 32 bp, Homo sapiens
cttttgttgcccaggctggagtgcaatggtgc

SEQ ID NO: 17648 - DNA, 32 bp, Homo sapiens
ctcttgttgcccaggctggagtgcaacggtgc

SEQ ID NO: 17649 - DNA, 32 bp, Homo sapiens
tcactatcacccaggctagagggcagtggcac

SEQ ID NO: 17650 - DNA, 28 bp, Homo sapiens
gttcgtcagctggctgcctcattgccac

SEQ ID NO: 17651 - DNA, 28 bp, Homo sapiens
ggctgccctggtgctgccacacttcagg

SEQ ID NO: 17652 - DNA, 32 bp, Homo sapiens
attctgtcacccaggctggagtgcaaaggtgc

SEQ ID NO: 17653 - DNA, 32 bp, Homo sapiens
agacatggaagaggaagaacaaagtcccctct

SEQ ID NO: 17654 - DNA, 32 bp, Homo sapiens
ctactcgggaggctgaggcaggagaaaggcat

SEQ ID NO: 17655 - DNA, 28 bp, Homo sapiens
tctcaacgactgttggcctcatcaagag

SEQ ID NO: 17656 - DNA, 23 bp, Homo sapiens
gggcggccagagcagcacagctg

SEQ ID NO: 17657 - DNA, 24 bp, Homo sapiens
tcacgcctgtaatcccagctcttt

SEQ ID NO: 17658 - DNA, 24 bp, Homo sapiens
tcatgcctgtaatcccagcccttt

SEQ ID NO: 17659 - DNA, 32 bp, Homo sapiens
ccgaacactgcagctgtctgaccttccaaaga

SEQ ID NO: 17660 - DNA, 32 bp, Homo sapiens
cttccttctgcagcagctttctgcttcttggg

SEQ ID NO: 17661 - DNA, 22 bp, Homo sapiens
tgtggggatcactgagatgagg

SEQ ID NO: 17662 - DNA, 23 bp, Homo sapiens
tggcataatctcggctcactgca

SEQ ID NO: 17663 - DNA, 23 bp, Homo sapiens
tggcatgatctcggctcactgcg

SEQ ID NO: 17664 - DNA, 32 bp, Homo sapiens
cgttttgttttctcttcttgggagacatctgt

SEQ ID NO: 17665 - DNA, 32 bp, Homo sapiens
ttcacacattttaaaaatgtttgctacttgtt

SEQ ID NO: 17666 - DNA, 32 bp, Homo sapiens
gaagaagaggaagaggaaagaaagacaagtca

SEQ ID NO: 17667 - DNA, 19 bp, Homo sapiens
caggggcagcctccagtcc

SEQ ID NO: 17668 - DNA, 32 bp, Homo sapiens
ctctctgcatccattccactctccactcttgc

SEQ ID NO: 17669 - DNA, 32 bp, Homo sapiens
gggggagccaggcttcggaatcactgagagag

SEQ ID NO: 17670 - DNA, 32 bp, Homo sapiens
actccgttgccaggctggagtgctgtggcgct

SEQ ID NO: 17671 - DNA, 32 bp, Homo sapiens
gcctcatgcctgcaatcctagcactttgggag

SEQ ID NO: 17672 - DNA, 32 bp, Homo sapiens
agcctcctcagtagctgggattacaggcatgt

SEQ ID NO: 17673 - DNA, 32 bp, Homo sapiens
cgcctcccaagtagctgggattacaggcatgc

SEQ ID NO: 17674 - DNA, 32 bp, Homo sapiens
ccctgacactgcactgagcactttatgagctt

SEQ ID NO: 17675 - DNA, 23 bp, Homo sapiens
tggcgcaatctcggctcactgta

SEQ ID NO: 17676 - DNA, 23 bp, Homo sapiens
tggcacaatctcagctcactgta

SEQ ID NO: 17677 - DNA, 32 bp, Homo sapiens
gaatttaatttccaagttacaaaatcattatc

SEQ ID NO: 17678 - DNA, 23 bp, Homo sapiens
tggtgcaatcttggctcactgta

SEQ ID NO: 17679 - DNA, 23 bp, Homo sapiens
tggcgtgatctcggctcactgcg

SEQ ID NO: 17680 - DNA, 23 bp, Homo sapiens
tggcgtaatctcggctcactgca

SEQ ID NO: 17681 - DNA, 32 bp, Homo sapiens
ctcttgttgcccaggcggagtgcagtggaaca

SEQ ID NO: 17682 - DNA, 32 bp, Homo sapiens
gcacactcccctgcactggagtccagtctctt

SEQ ID NO: 17683 - DNA, 32 bp, Homo sapiens
taaaaactgcattggctgggtgcagtggctca

SEQ ID NO: 17684 - DNA, 32 bp, Homo sapiens
tggaggtatgttcttcatgcaagggcagttcc

SEQ ID NO: 17685 - DNA, 32 bp, Homo sapiens
acaaagaaagagaaaggggccgggcgcggtgg

SEQ ID NO: 17686 - DNA, 32 bp, Homo sapiens
tgcatctgcccacgatggcagtgcagtcatca

SEQ ID NO: 17687 - DNA, 32 bp, Homo sapiens
ctcaccctcagtagctgggattattggcatgc

SEQ ID NO: 17688 - DNA, 32 bp, Homo sapiens
ctctgtcatccaggctggagtgcagtggcatg

SEQ ID NO: 17689 - DNA, 32 bp, Homo sapiens
ttttattgcccaggctggagtgtagtggcgca

SEQ ID NO: 17690 - DNA, 32 bp, Homo sapiens
acctccacctcctgggttcaaacaattctcct

SEQ ID NO: 17691 - DNA, 18 bp, Homo sapiens
cccctgagctttcaggta

SEQ ID NO: 17692 - DNA, 32 bp, Homo sapiens
gatcactggagttcgaggctgcagtgagctat

SEQ ID NO: 17693 - DNA, 32 bp, Homo sapiens
acctccacctcctaggttcaagcaattctcct

SEQ ID NO: 17694 - DNA, 32 bp, Homo sapiens
tttgcatgctaaaattctcccggcctcatcct

SEQ ID NO: 17695 - DNA, 32 bp, Homo sapiens
cggagccgtaaccttgaggcggcggcggcggg

SEQ ID NO: 17696 - DNA, 32 bp, Homo sapiens
gagtgggagatcatcttggaatggcagtggcc

SEQ ID NO: 17697 - DNA, 32 bp, Homo sapiens
tgacagtgtggcattactgataagttatggaa

SEQ ID NO: 17698 - DNA, 32 bp, Homo sapiens
cagtattcaagtgccttgaacagtgtcccctc

SEQ ID NO: 17699 - DNA, 32 bp, Homo sapiens
gaaccctggaggtggaggttgcagtgagccga

SEQ ID NO: 17700 - DNA, 32 bp, Homo sapiens
gaacccgggaggtgtaggttgcagtgagccga

SEQ ID NO: 17701 - DNA, 32 bp, Homo sapiens
tcatggcaacatcagctttctaatgttctaaa

SEQ ID NO: 17702 - DNA, 32 bp, Homo sapiens
gggacactctgggccggccttctgcctgcatg

SEQ ID NO: 17703 - DNA, 32 bp, Homo sapiens
gtggcctgccccagctctcttctggctttctg

SEQ ID NO: 17704 - DNA, 31 bp, Homo sapiens
tctccaaccagggcagaaaggagggaggatt

SEQ ID NO: 17705 - DNA, 32 bp, Homo sapiens
gaccctccagttctgccacaggtctgccgatg

SEQ ID NO: 17706 - DNA, 32 bp, Homo sapiens
tggaggcattctaagtcacaggatgagacagg

SEQ ID NO: 17707 - DNA, 32 bp, Homo sapiens
tctcatcacctatcctggaactgatgcaatta

SEQ ID NO: 17708 - DNA, 32 bp, Homo sapiens
tagtgaaaaggtgagttatgagcttagattac

SEQ ID NO: 17709 - DNA, 32 bp, Homo sapiens
gcctgcctcctaggctggaagccatggtcccg

SEQ ID NO: 17710 - DNA, 32 bp, Homo sapiens
ctctgtcccctgggctggagtgcaatggtgcg

SEQ ID NO: 17711 - DNA, 32 bp, Homo sapiens
tccccagcctccaactcatcacctctcaggcc

SEQ ID NO: 17712 - DNA, 32 bp, Homo sapiens
tcactgtcaaccaggccagagtgcagtgaaga

SEQ ID NO: 17713 - DNA, 32 bp, Homo sapiens
cctctgttgtccaagctagagtgcagtgatac

SEQ ID NO: 17714 - DNA, 32 bp, Homo sapiens
gaacccaggcagtggaggttgcagtgagccaa

SEQ ID NO: 17715 - DNA, 32 bp, Homo sapiens
tgactgaatgtgtttcaaatgggtggtggggt

SEQ ID NO: 17716 - DNA, 19 bp, Homo sapiens
gcaggagagggaaaggcag

SEQ ID NO: 17717 - DNA, 32 bp, Homo sapiens
aacaaggatttccaagctaagcaagtcatcag

SEQ ID NO: 17718 - DNA, 32 bp, Homo sapiens
gagagaggaagaggagcagaagggggcagcag

SEQ ID NO: 17719 - DNA, 32 bp, Homo sapiens
cagcctgccagtctgtcattgtcagggaccag

SEQ ID NO: 17720 - DNA, 22 bp, Homo sapiens
tgatgagtttctgaaactggag

SEQ ID NO: 17721 - DNA, 32 bp, Homo sapiens
gtgccacatcttctccccctttatccctacaa

SEQ ID NO: 17722 - DNA, 32 bp, Homo sapiens
caccgtcccccaggctggagtgccgtggcgtg

SEQ ID NO: 17723 - DNA, 32 bp, Homo sapiens
ctctgttgcccaggctagagtgcagtggcatg

SEQ ID NO: 17724 - DNA, 32 bp, Homo sapiens
ctctgttgcccaggctggagtacaatggcgtg

SEQ ID NO: 17725 - DNA, 32 bp, Homo sapiens
ctcaccctcctgagctgggattacaggcgcct

SEQ ID NO: 17726 - DNA, 32 bp, Homo sapiens
ctctgttgcccaggctggagtgcaatggcatg

SEQ ID NO: 17727 - DNA, 32 bp, Homo sapiens
caccctgaacaacgagccttttcacccttcta

SEQ ID NO: 17728 - DNA, 32 bp, Homo sapiens
cgactgagaagaggtgcaaggaagcgggctcc

SEQ ID NO: 17729 - DNA, 32 bp, Homo sapiens
acctccgcctcctgggttcaagcaagtctcct

SEQ ID NO: 17730 - DNA, 28 bp, Homo sapiens
aggcccccgcaggctgcctcttcccaac

SEQ ID NO: 17731 - DNA, 32 bp, Homo sapiens
cctctgttgccaggctggaatgccgtggcgca

SEQ ID NO: 17732 - DNA, 18 bp, Homo sapiens
ggagagagagcaccgaga

SEQ ID NO: 17733 - DNA, 19 bp, Homo sapiens
gcccctgttcctccaagtg

SEQ ID NO: 17734 - DNA, 32 bp, Homo sapiens
ccttcagcctccatgcatccagttttgagtca

SEQ ID NO: 17735 - DNA, 32 bp, Homo sapiens
gcctcgagatgcgccacctcccagaaagccag

SEQ ID NO: 17736 - DNA, 32 bp, Homo sapiens
ctctgttgcctaggctggagtacagtggcaag

SEQ ID NO: 17737 - DNA, 32 bp, Homo sapiens
aagggggctgggcagagggtggaggaggtcct

SEQ ID NO: 17738 - DNA, 32 bp, Homo sapiens
ccgcagcccagtgccctctgcccgcggcggtg

SEQ ID NO: 17739 - DNA, 32 bp, Homo sapiens
tcacctggattttgagaaagaaaataacttct

SEQ ID NO: 17740 - DNA, 32 bp, Homo sapiens
tggggtcaagacaggtgacaccagcactttaa

SEQ ID NO: 17741 - DNA, 32 bp, Homo sapiens
ctacttgggaggcagaggcaggagaattgctt

SEQ ID NO: 17742 - DNA, 32 bp, Homo sapiens
ctctgtcgtccaggctggagtgcagtggcgca

SEQ ID NO: 17743 - DNA, 32 bp, Homo sapiens
ctttgtcacccatgctggagtacaatggcaca

SEQ ID NO: 17744 - DNA, 22 bp, Homo sapiens
gctcccacccctgaccttctcc

SEQ ID NO: 17745 - DNA, 32 bp, Homo sapiens
atccacagtgtggatggatacttatttggtga

SEQ ID NO: 17746 - DNA, 32 bp, Homo sapiens
tgatggaggaaggatggatttggttaccagat

SEQ ID NO: 17747 - DNA, 32 bp, Homo sapiens
gctcctgaacaacaggcctcatgcctctcttt

SEQ ID NO: 17748 - DNA, 32 bp, Homo sapiens
gcaaccaggcctgaggtcagaatttgaacata

SEQ ID NO: 17749 - DNA, 32 bp, Homo sapiens
agcctcctgagtagctgggaccacaggtatgc

SEQ ID NO: 17750 - DNA, 32 bp, Homo sapiens
cactgtcacctaggctggagtgcagtggtaaa

SEQ ID NO: 17751 - DNA, 32 bp, Homo sapiens
gtgtgcagtaggacctgctcccctgaaggacg

SEQ ID NO: 17752 - DNA, 19 bp, Homo sapiens
ttggactggtggcatcatg

SEQ ID NO: 17753 - DNA, 32 bp, Homo sapiens
gagcccaggaggtctaggctgcagtgagctta

SEQ ID NO: 17754 - DNA, 32 bp, Homo sapiens
gagcctgggaggtcaaggctgcagtgagccga

SEQ ID NO: 17755 - DNA, 32 bp, Homo sapiens
tcttgttacccaggctggagtgcagtggcgtg

SEQ ID NO: 17756 - DNA, 32 bp, Homo sapiens
aaaagaagaaagacacaaagaaaataatctaa

SEQ ID NO: 17757 - DNA, 32 bp, Homo sapiens
catcgtccagttctgaccatggactcgcagcc

SEQ ID NO: 17758 - DNA, 32 bp, Homo sapiens
ctttgtcacccaggctggagtgcagtgtcgtg

SEQ ID NO: 17759 - DNA, 32 bp, Homo sapiens
tcttgtcacccaggctggagtgcagtggcgcg

SEQ ID NO: 17760 - DNA, 32 bp, Homo sapiens
tcttgtcacccaggctggagtacagtggcacg

SEQ ID NO: 17761 - DNA, 32 bp, Homo sapiens
agtctgaaggctgggagctcttggggctgggc

SEQ ID NO: 17762 - DNA, 32 bp, Homo sapiens
tcttgtcgcccaggctggagtgcagtggcgca

SEQ ID NO: 17763 - DNA, 32 bp, Homo sapiens
cgctctgtcgccaggctggagtgcagtggtgc

SEQ ID NO: 17764 - DNA, 32 bp, Homo sapiens
ggctttgcagggcggccagtgcagtgatgcct

SEQ ID NO: 17765 - DNA, 32 bp, Homo sapiens
cattgaacctcttgggttcaagtgattcttgt

SEQ ID NO: 17766 - DNA, 32 bp, Homo sapiens
ttctaacccaaaacagttctactcacttcctt

SEQ ID NO: 17767 - DNA, 32 bp, Homo sapiens
aagaggaggaggaaggaaagaaagaaagcgag

SEQ ID NO: 17768 - DNA, 32 bp, Homo sapiens
gaacccaggagacatgggttgcagtgagccga

SEQ ID NO: 17769 - DNA, 32 bp, Homo sapiens
gtctccctcatcaccgactacagggtccggtt

SEQ ID NO: 17770 - DNA, 32 bp, Homo sapiens
tcctgacctaaccttagaactggattagggtg

SEQ ID NO: 17771 - DNA, 32 bp, Homo sapiens
gtccttgtataaggagctttgctcttggaatt

SEQ ID NO: 17772 - DNA, 24 bp, Homo sapiens
tggcgcgatctcggctcactgcag

SEQ ID NO: 17773 - DNA, 24 bp, Homo sapiens
tggcatgatctcagctcactgtag

SEQ ID NO: 17774 - DNA, 17 bp, Homo sapiens
tctccagcctccttgta

SEQ ID NO: 17775 - DNA, 32 bp, Homo sapiens
gacagttgaataatcaaaaatattttattagg

SEQ ID NO: 17776 - DNA, 32 bp, Homo sapiens
taataatggagtttaccagtgcttgtcaacta

SEQ ID NO: 17777 - DNA, 24 bp, Homo sapiens
tggcacgatctcagctcactgcag

SEQ ID NO: 17778 - DNA, 32 bp, Homo sapiens
ctttgttgcccaggctggagcgcagtggggtg

SEQ ID NO: 17779 - DNA, 32 bp, Homo sapiens
aataaatgtctctgattactttgctaccttta

SEQ ID NO: 17780 - DNA, 32 bp, Homo sapiens
ggaggaggaggaggagaaggaggagggcagct

SEQ ID NO: 17781 - DNA, 32 bp, Homo sapiens
ggtctttcacccaggctggagtgcagtgctgt

SEQ ID NO: 17782 - DNA, 32 bp, Homo sapiens
agatgcccctgagaccacccagaaatcaagcg

SEQ ID NO: 17783 - DNA, 22 bp, Homo sapiens
catctgcacctgcactcccaaa

SEQ ID NO: 17784 - DNA, 32 bp, Homo sapiens
ctgaagagaccagtgagctcactgtgacccac

SEQ ID NO: 17785 - DNA, 32 bp, Homo sapiens
gctctgttgcctaggctggagtgcagtgaggc

SEQ ID NO: 17786 - DNA, 32 bp, Homo sapiens
gagtccttgcccaggctggagtgcagtggcgc

SEQ ID NO: 17787 - DNA, 32 bp, Homo sapiens
gcccaaatctagagcattgagcactttatctc

SEQ ID NO: 17788 - DNA, 32 bp, Homo sapiens
ctgctgttgatagcaggaaaccacctgctggg

SEQ ID NO: 17789 - DNA, 32 bp, Homo sapiens
catatacaagggagcccttcactgttgataca

SEQ ID NO: 17790 - DNA, 32 bp, Homo sapiens
atctccgcctcccgggttcaagtgattctcct

SEQ ID NO: 17791 - DNA, 32 bp, Homo sapiens
ggtctgacacctgggctggagtgcagtggtgc

SEQ ID NO: 17792 - DNA, 32 bp, Homo sapiens
gccctgtcgcccaggctggagtgccatggcgc

SEQ ID NO: 17793 - DNA, 32 bp, Homo sapiens
agtcacagagaggggaagagaaaacagggacg

SEQ ID NO: 17794 - DNA, 32 bp, Homo sapiens
cacaggatcccaagagggagatcatgagcctt

SEQ ID NO: 17795 - DNA, 32 bp, Homo sapiens
gctcaggtgggacgagggctgcagtgaaggcc

SEQ ID NO: 17796 - DNA, 23 bp, Homo sapiens
tggcaccatctcgtctcactgca

SEQ ID NO: 17797 - DNA, 32 bp, Homo sapiens
ctccaacgtcttctccatgtttgatcagtccc

SEQ ID NO: 17798 - DNA, 32 bp, Homo sapiens
gaggagggaagaggaagaggcaaggggagggt

SEQ ID NO: 17799 - DNA, 32 bp, Homo sapiens
ctgacctcaagcgatctgcccacctcggcctc

SEQ ID NO: 17800 - DNA, 32 bp, Homo sapiens
tggatgtgcaagaccagccactggaggtagct

SEQ ID NO: 17801 - DNA, 32 bp, Homo sapiens
tccggatggagtttcccctctgcggctgcctc

SEQ ID NO: 17802 - DNA, 28 bp, Homo sapiens
acccaccacagcgcagcctcatcaaaat

SEQ ID NO: 17803 - DNA, 32 bp, Homo sapiens
ctactcgggaggctgaggcagagaattgcttg

SEQ ID NO: 17804 - DNA, 32 bp, Homo sapiens
gctcagaggaggcagagatggggtggtggctg

SEQ ID NO: 17805 - DNA, 32 bp, Homo sapiens
ccagcctggtggcagaggaagcaggtggcacc

SEQ ID NO: 17806 - DNA, 32 bp, Homo sapiens
tttgtttttactcaatgacaccatttttagtt

SEQ ID NO: 17807 - DNA, 21 bp, Homo sapiens
tgtggggagaatggacaagga

SEQ ID NO: 17808 - DNA, 32 bp, Homo sapiens
gaaccctggaggtagaagttgcagtgagccaa

SEQ ID NO: 17809 - DNA, 32 bp, Homo sapiens
atactagcactactattcttagcagtgcttgg

SEQ ID NO: 17810 - DNA, 32 bp, Homo sapiens
aagctgtgaacaggctgggctgctggaggtgg

SEQ ID NO: 17811 - DNA, 24 bp, Homo sapiens
cgacggccgccgcggagctccgag

SEQ ID NO: 17812 - DNA, 32 bp, Homo sapiens
actttggaggaatcttttgaatgtgatggatc

SEQ ID NO: 17813 - DNA, 32 bp, Homo sapiens
tctagaggaagtatctattcactgtgaaaatc

SEQ ID NO: 17814 - DNA, 32 bp, Homo sapiens
actctgttgctcaagctggagtggagtggcac

SEQ ID NO: 17815 - DNA, 32 bp, Homo sapiens
cagggttcaagtgattctcccacctcagcctc

SEQ ID NO: 17816 - DNA, 32 bp, Homo sapiens
gggaggtggaggcaggcactgaataaggtccc

SEQ ID NO: 17817 - DNA, 32 bp, Homo sapiens
gccatgagaagactcttcctgggcacggcgtg

SEQ ID NO: 17818 - DNA, 32 bp, Homo sapiens
acctccacttcccgggttcaagcgattctcct

SEQ ID NO: 17819 - DNA, 32 bp, Homo sapiens
cctcatcatcttctccaactgacacctagtta

SEQ ID NO: 17820 - DNA, 24 bp, Homo sapiens
tcatgtctctaatcccagcacttt

SEQ ID NO: 17821 - DNA, 19 bp, Homo sapiens
cctggaatcccagcacttt

SEQ ID NO: 17822 - DNA, 32 bp, Homo sapiens
cacttctgtcgaggagcttcggggctcagaga

SEQ ID NO: 17823 - DNA, 32 bp, Homo sapiens
ccctctcttttgggagcttctctgggcagaat

SEQ ID NO: 17824 - DNA, 32 bp, Homo sapiens
cttaacttttctgtacctcttctgtttttgta

SEQ ID NO: 17825 - DNA, 32 bp, Homo sapiens
cagcagcacaaccttgaccagagcttgggtcc

SEQ ID NO: 17826 - DNA, 32 bp, Homo sapiens
acctccagagcctccaggggaccacacagtag

SEQ ID NO: 17827 - DNA, 32 bp, Homo sapiens
ggtattcctcaagcccagcatccatctggtga

SEQ ID NO: 17828 - DNA, 32 bp, Homo sapiens
aggccctagcagtcctgctaccacagatccca

SEQ ID NO: 17829 - DNA, 24 bp, Homo sapiens
tggtgcaatctcggctcactgtag

SEQ ID NO: 17830 - DNA, 32 bp, Homo sapiens
actggtctgctgctgcaggcttcatctaaaac

SEQ ID NO: 17831 - DNA, 32 bp, Homo sapiens
acttgttgcccaggctggagtgcaatggtaca

SEQ ID NO: 17832 - DNA, 32 bp, Homo sapiens
gatagtttacctgaataaatggtagtaatcac

SEQ ID NO: 17833 - DNA, 32 bp, Homo sapiens
cagcctattaactgtgtcttagcaatgttgta

SEQ ID NO: 17834 - DNA, 32 bp, Homo sapiens
tctgcagcaagcttcttcctggacatccagac

SEQ ID NO: 17835 - DNA, 32 bp, Homo sapiens
gtagattctgatttccgaatggtgctgcggaa

SEQ ID NO: 17836 - DNA, 32 bp, Homo sapiens
ccctgtccaagtgccttggagaactcacagca

SEQ ID NO: 17837 - DNA, 32 bp, Homo sapiens
gaacccataaggcagaggttgcagtgagctga

SEQ ID NO: 17838 - DNA, 32 bp, Homo sapiens
gaacctggcaggcagagtttgcagtgaaccaa

SEQ ID NO: 17839 - DNA, 32 bp, Homo sapiens
tgtgcatttttgcccttctttctgcctctcag

SEQ ID NO: 17840 - DNA, 32 bp, Homo sapiens
ctcacatggcttctccccacgaaggtcccagg

SEQ ID NO: 17841 - DNA, 32 bp, Homo sapiens
ccgtatagaagagaagactcaatggaagacag

SEQ ID NO: 17842 - DNA, 32 bp, Homo sapiens
tcggagtggagtttcctagctggtgcctgtcc

SEQ ID NO: 17843 - DNA, 32 bp, Homo sapiens
cccccgcccctctcttccctggctggacttgc

SEQ ID NO: 17844 - DNA, 32 bp, Homo sapiens
tgggtctctgcaggcctgctcacctgcctcca

SEQ ID NO: 17845 - DNA, 32 bp, Homo sapiens
tatggattactttgaaacttagcaatgagagt

SEQ ID NO: 17846 - DNA, 23 bp, Homo sapiens
gctgggtccccccaaccttcccc

SEQ ID NO: 17847 - DNA, 32 bp, Homo sapiens
gaaaagctgattctggttatctctttaaggac

SEQ ID NO: 17848 - DNA, 32 bp, Homo sapiens
actgtgttgcccaggctagagtgcagtggtgc

SEQ ID NO: 17849 - DNA, 32 bp, Homo sapiens
gctctgttgcccattctggagtgcagtggtgt

SEQ ID NO: 17850 - DNA, 32 bp, Homo sapiens
gtaaagaacccaaggttgagtgcaactggggt

SEQ ID NO: 17851 - DNA, 32 bp, Homo sapiens
ctggcctcaagcactccacccacctcggcctc

SEQ ID NO: 17852 - DNA, 32 bp, Homo sapiens
agcctcctgagtagctgtgattacaggcatgc

SEQ ID NO: 17853 - DNA, 32 bp, Homo sapiens
gtcacccaggctggagtgtagtggcgcaatct

SEQ ID NO: 17854 - DNA, 32 bp, Homo sapiens
ctgctcgggaggctgaggcaggagaatctctt

SEQ ID NO: 17855 - DNA, 32 bp, Homo sapiens
aaggcccacatcctacaattgctacttcctga

SEQ ID NO: 17856 - DNA, 32 bp, Homo sapiens
aaattagtgtcaggcagttcccagaaagagac

SEQ ID NO: 17857 - DNA, 22 bp, Homo sapiens
ctggagaacatgagctgagttg

SEQ ID NO: 17858 - DNA, 32 bp, Homo sapiens
tactctgttgctaggctggagtgcagtggtgc

SEQ ID NO: 17859 - DNA, 32 bp, Homo sapiens
gagttttgcccaggcctgctgtcttgagtaca

SEQ ID NO: 17860 - DNA, 32 bp, Homo sapiens
agatggcacatccttgctgctggggacttggc

SEQ ID NO: 17861 - DNA, 32 bp, Homo sapiens
ccaggttcaagcagttctcctgtctcagcctc

SEQ ID NO: 17862 - DNA, 32 bp, Homo sapiens
agcctcctgagtagctgggattataggtacat

SEQ ID NO: 17863 - DNA, 32 bp, Homo sapiens
agcttcccgagtagctgggattataggcacac

SEQ ID NO: 17864 - DNA, 32 bp, Homo sapiens
caagcttggcattgacatgtgctgctagttta

SEQ ID NO: 17865 - DNA, 32 bp, Homo sapiens
acctccacctctgggattcaagcaattctccc

SEQ ID NO: 17866 - DNA, 28 bp, Homo sapiens
caaagcttaaccgctgcctcctgtcccc

SEQ ID NO: 17867 - DNA, 32 bp, Homo sapiens
ctgctttctttgctttctcttctcacctttgg

SEQ ID NO: 17868 - DNA, 18 bp, Homo sapiens
tgcgggaggaagtgggga

SEQ ID NO: 17869 - DNA, 32 bp, Homo sapiens
ttgcacgttcttctcccatcttggaatatcca

SEQ ID NO: 17870 - DNA, 32 bp, Homo sapiens
cgccaacatcctcctccacaggcagtggcagg

SEQ ID NO: 17871 - DNA, 32 bp, Homo sapiens
gattgcgcctgagatacaaggcccagaagcct

SEQ ID NO: 17872 - DNA, 21 bp, Homo sapiens
gggtggctgcgtctgaaggct

SEQ ID NO: 17873 - DNA, 32 bp, Homo sapiens
ggtgcgggctccgaattctttccaatagtctg

SEQ ID NO: 17874 - DNA, 32 bp, Homo sapiens
gacatgctggtgttgtcataccacacgacacg

SEQ ID NO: 17875 - DNA, 32 bp, Homo sapiens
ggttctctatttgagtctgtgttttcaataaa

SEQ ID NO: 17876 - DNA, 32 bp, Homo sapiens
ctgggctcaagtgcttctcccacctcagcctc

SEQ ID NO: 17877 - DNA, 32 bp, Homo sapiens
taatggtggcctggggcttctgaggcttctgg

SEQ ID NO: 17878 - DNA, 32 bp, Homo sapiens
aggaggaaggctgaggaatgacttggctccag

SEQ ID NO: 17879 - DNA, 32 bp, Homo sapiens
taatactcaaaccattgtaaagttgctgacta

SEQ ID NO: 17880 - DNA, 28 bp, Homo sapiens
gccacaccaagtgcagccctcgtcctgg

SEQ ID NO: 17881 - DNA, 32 bp, Homo sapiens
tttaacctgaaccttgagcaaattagttggtt

SEQ ID NO: 17882 - DNA, 32 bp, Homo sapiens
tgtgcccagagtagcccaggtcactgttaact

SEQ ID NO: 17883 - DNA, 24 bp, Homo sapiens
tcacgcctgcagtcccagcacttt

SEQ ID NO: 17884 - DNA, 32 bp, Homo sapiens
ctgggttcaagtgattctcccacctcaacctc

SEQ ID NO: 17885 - DNA, 32 bp, Homo sapiens
gccctggagagtcgctgggatgcacggtgggc

SEQ ID NO: 17886 - DNA, 32 bp, Homo sapiens
accatcccaaactcctcccaggcacagtctgg

SEQ ID NO: 17887 - DNA, 32 bp, Homo sapiens
cagctcccgggagcccttaagccccagctgtc

SEQ ID NO: 17888 - DNA, 32 bp, Homo sapiens
gagcctgggggactgaggctgcagtgagccat

SEQ ID NO: 17889 - DNA, 32 bp, Homo sapiens
acgtccacctcttgagttcaagcgattctcct

SEQ ID NO: 17890 - DNA, 32 bp, Homo sapiens
ccgcagacctttctgtcatgctgggaagtatc

SEQ ID NO: 17891 - DNA, 32 bp, Homo sapiens
acaatgatacttctttttatctctttagtatg

SEQ ID NO: 17892 - DNA, 17 bp, Homo sapiens
gccttagcgacccagaa

SEQ ID NO: 17893 - DNA, 32 bp, Homo sapiens
gctcatgcctgtaatctccagcactttgggag

SEQ ID NO: 17894 - DNA, 32 bp, Homo sapiens
cttgattgtccctggatggagtgcagtcacct

SEQ ID NO: 17895 - DNA, 32 bp, Homo sapiens
gagagaaacagaggagacagagagggagagag

SEQ ID NO: 17896 - DNA, 28 bp, Homo sapiens
gagccgccgggcgctgcctcgccagacc

SEQ ID NO: 17897 - DNA, 32 bp, Homo sapiens
gacccaagcaatcccaacctggtgctaggtca

SEQ ID NO: 17898 - DNA, 32 bp, Homo sapiens
ctgggttcaagcaaatctcctgcctcagcctc

SEQ ID NO: 17899 - DNA, 32 bp, Homo sapiens
tgtctaagagcctgttttggaaacacaagctg

SEQ ID NO: 17900 - DNA, 32 bp, Homo sapiens
ggaagaagaagaggaggaagaagatatcctct

SEQ ID NO: 17901 - DNA, 32 bp, Homo sapiens
gaacccgggaggcagagatagcagtgaactga

SEQ ID NO: 17902 - DNA, 32 bp, Homo sapiens
tgcccctgtctgctgctcccagtctctcgctc

SEQ ID NO: 17903 - DNA, 32 bp, Homo sapiens
atttatcttctgctgctgcttggagttacatt

SEQ ID NO: 17904 - DNA, 22 bp, Homo sapiens
tctctgcctatgcaaaaattca

SEQ ID NO: 17905 - DNA, 32 bp, Homo sapiens
acagtctcacccagactccaggctgtctttca

SEQ ID NO: 17906 - DNA, 32 bp, Homo sapiens
tccttccagggtttagggagtgcagtgatgtc

SEQ ID NO: 17907 - DNA, 32 bp, Homo sapiens
tgattttaattgcttgaaacaactttcagggt

SEQ ID NO: 17908 - DNA, 32 bp, Homo sapiens
gcacagagctctgcggagaccacgccgacatc

SEQ ID NO: 17909 - DNA, 32 bp, Homo sapiens
tggagctggagaagctgggacacatggcacca

SEQ ID NO: 17910 - DNA, 32 bp, Homo sapiens
tgatgagtctgtggctggagacagtggggtct

SEQ ID NO: 17911 - DNA, 32 bp, Homo sapiens
ccaccctgtccctgtatctcccatggaagatg

SEQ ID NO: 17912 - DNA, 32 bp, Homo sapiens
ggaggtaggggctgggcatgcaccttggttaa

SEQ ID NO: 17913 - DNA, 18 bp, Homo sapiens
cagggaagtccccaggcc

SEQ ID NO: 17914 - DNA, 32 bp, Homo sapiens
gggcttcatccctgtgaaggcacagggcctgc

SEQ ID NO: 17915 - DNA, 22 bp, Homo sapiens
ctgcctgacccactgttgcaga

SEQ ID NO: 17916 - DNA, 32 bp, Homo sapiens
agcctcctgaatagctgggattacaggcacct

SEQ ID NO: 17917 - DNA, 32 bp, Homo sapiens
ggtagtttgacctccgttggtgcaatgccaga

SEQ ID NO: 17918 - DNA, 23 bp, Homo sapiens
catcagcaccacgtgccaaggag

SEQ ID NO: 17919 - DNA, 32 bp, Homo sapiens
gggagaagaagaggaagaccacagtatttctc

SEQ ID NO: 17920 - DNA, 32 bp, Homo sapiens
tttgggcactgtctttttaagagaccaaggca

SEQ ID NO: 17921 - DNA, 32 bp, Homo sapiens
ctcctgttcctgccttctcttctatcctgcaa

SEQ ID NO: 17922 - DNA, 32 bp, Homo sapiens
gagcctccagtagcttctctgggcctggcaga

SEQ ID NO: 17923 - DNA, 32 bp, Homo sapiens
gcgggctgcccaggcagtgcagagcggagaga

SEQ ID NO: 17924 - DNA, 32 bp, Homo sapiens
gccctctggccttttgcagctgatccagagga

SEQ ID NO: 17925 - DNA, 32 bp, Homo sapiens
tttctagcagaactccaggtcctctgagttaa

SEQ ID NO: 17926 - DNA, 32 bp, Homo sapiens
aaacaatacaaagcccagaaattcttttcggg

SEQ ID NO: 17927 - DNA, 32 bp, Homo sapiens
gctctgtctccaggctggagtacagtggtgcg

SEQ ID NO: 17928 - DNA, 32 bp, Homo sapiens
acctttctgagagaggcaccactgtgaccttc

SEQ ID NO: 17929 - DNA, 32 bp, Homo sapiens
cacccctgtcctcactgctccctgaagcccag

SEQ ID NO: 17930 - DNA, 28 bp, Homo sapiens
ctccagagacctgttgcctcatctcttt

SEQ ID NO: 17931 - DNA, 32 bp, Homo sapiens
aacaccccaagtgtccgggaacaaaggcaagt

SEQ ID NO: 17932 - DNA, 32 bp, Homo sapiens
tgtggtttccaaggagctgagaatagaaggaa

SEQ ID NO: 17933 - DNA, 32 bp, Homo sapiens
tggactcagaaaaacacacaccaccttttggc

SEQ ID NO: 17934 - DNA, 32 bp, Homo sapiens
ataaagcctagagtgatatgtttatctataaa

SEQ ID NO: 17935 - DNA, 32 bp, Homo sapiens
ctctgtcacccaggctggagtgccatagtgtg

SEQ ID NO: 17936 - DNA, 32 bp, Homo sapiens
ggcagctggtgtttcgctcctggagtgtgcct

SEQ ID NO: 17937 - DNA, 32 bp, Homo sapiens
tcctgtgggccctctttcaaagtccagcctag

SEQ ID NO: 17938 - DNA, 32 bp, Homo sapiens
ggctcatgcctgtgatcccagcactttgggag

SEQ ID NO: 17939 - DNA, 32 bp, Homo sapiens
ggctcgtgcctgtaatcccagcactttgggag

SEQ ID NO: 17940 - DNA, 32 bp, Homo sapiens
ggctcatgcctgtaatcccagcactttggaag

SEQ ID NO: 17941 - DNA, 32 bp, Homo sapiens
gctgccgggaggcgggagggagtgccctgaaa

SEQ ID NO: 17942 - DNA, 32 bp, Homo sapiens
ggacagtgtgccacctgctgtctgagaggcag

SEQ ID NO: 17943 - DNA, 32 bp, Homo sapiens
cttcactgtgcagcttctggggtggcctgggc

SEQ ID NO: 17944 - DNA, 21 bp, Homo sapiens
tcatgcctataatcccagcac

SEQ ID NO: 17945 - DNA, 32 bp, Homo sapiens
tccgggagaaggcagagggcagaggcaggaaa

SEQ ID NO: 17946 - DNA, 32 bp, Homo sapiens
aggactttgctgctgctattgcacttcaccag

SEQ ID NO: 17947 - DNA, 32 bp, Homo sapiens
tataagagtgcctctttcataaaaccaaatgc

SEQ ID NO: 17948 - DNA, 23 bp, Homo sapiens
ggtctggttcaccaatggggaca

SEQ ID NO: 17949 - DNA, 32 bp, Homo sapiens
agcactgtctcaggctggaggtcagcgaacct

SEQ ID NO: 17950 - DNA, 32 bp, Homo sapiens
tttttggatcagctcagacatatttcagtata

SEQ ID NO: 17951 - DNA, 19 bp, Homo sapiens
tgatcttggctcactgcag

SEQ ID NO: 17952 - DNA, 32 bp, Homo sapiens
ctctgtcacccaggctggagtgcagtggcaca

SEQ ID NO: 17953 - DNA, 32 bp, Homo sapiens
ctctgttgcccagactggagtgcagtggcgtg

SEQ ID NO: 17954 - DNA, 32 bp, Homo sapiens
tcttgtcacccaggctggagtgcagtagtgcg

SEQ ID NO: 17955 - DNA, 32 bp, Homo sapiens
ctttgtcacctaagctggagtgcagtgcgcga

SEQ ID NO: 17956 - DNA, 32 bp, Homo sapiens
ctctgttgcccaggttggagtgcagtggcacg

SEQ ID NO: 17957 - DNA, 32 bp, Homo sapiens
ccctgttgcccaggctggaatacagtggcacg

SEQ ID NO: 17958 - DNA, 32 bp, Homo sapiens
gctctgttgcccagactggagtgcagtggtgt

SEQ ID NO: 17959 - DNA, 32 bp, Homo sapiens
actctgtcacccaggctggagtgcagtggtac

SEQ ID NO: 17960 - DNA, 32 bp, Homo sapiens
ctctgtcgcccaggctggagtgtagtggcatg

SEQ ID NO: 17961 - DNA, 32 bp, Homo sapiens
attagaagaaacacaccttcaaacttcaactt

SEQ ID NO: 17962 - DNA, 32 bp, Homo sapiens
gctctgtcgcccaggctggagtgcagtggtac

SEQ ID NO: 17963 - DNA, 32 bp, Homo sapiens
gctctgttgcccaggctggagtgcagtggtat

SEQ ID NO: 17964 - DNA, 32 bp, Homo sapiens
ctctgttgcccaggctggagtgcagtggcatg

SEQ ID NO: 17965 - DNA, 32 bp, Homo sapiens
ctctgttgcccaggctggagtacagtggcgtg

SEQ ID NO: 17966 - DNA, 32 bp, Homo sapiens
attgtagctgccattccatctgttctagggag

SEQ ID NO: 17967 - DNA, 32 bp, Homo sapiens
gaccacaggcctggctaaattttgactttttg

SEQ ID NO: 17968 - DNA, 32 bp, Homo sapiens
agcctccctagcagctgggactattagtgcac

SEQ ID NO: 17969 - DNA, 32 bp, Homo sapiens
ctctgtcgcccaggctggagtgcagtggcacg

SEQ ID NO: 17970 - DNA, 32 bp, Homo sapiens
cagacctctagagtgtcctagattttgtggca

SEQ ID NO: 17971 - DNA, 32 bp, Homo sapiens
acctccaccccccaggttcaagcagttcttcc

SEQ ID NO: 17972 - DNA, 32 bp, Homo sapiens
ttccttctagaaggagcttcctgactggaacc

SEQ ID NO: 17973 - DNA, 32 bp, Homo sapiens
cattctctctccttttccatctggaccaccca

SEQ ID NO: 17974 - DNA, 32 bp, Homo sapiens
gctgctggtgtctgtctcagggtacggtgcag

SEQ ID NO: 17975 - DNA, 32 bp, Homo sapiens
atcatcttacaaatgcctctttgctactttgt

SEQ ID NO: 17976 - DNA, 32 bp, Homo sapiens
ggccacagctcaggctgggctgtggtgccagc

SEQ ID NO: 17977 - DNA, 32 bp, Homo sapiens
tgaagtcttaacccttggtaccacagaatatc

SEQ ID NO: 17978 - DNA, 32 bp, Homo sapiens
gtcctgagggttaggctggagtgacagtttcc

SEQ ID NO: 17979 - DNA, 32 bp, Homo sapiens
ggtgcctgtgagctcatctcccaggatggtga

SEQ ID NO: 17980 - DNA, 32 bp, Homo sapiens
tgctccggcccaggcgggggagtcagtgccca

SEQ ID NO: 17981 - DNA, 32 bp, Homo sapiens
actgtctcctctgctcctcccacctcatccct

SEQ ID NO: 17982 - DNA, 32 bp, Homo sapiens
tctcccaggcctgggtggcctctgtagctggt

SEQ ID NO: 17983 - DNA, 32 bp, Homo sapiens
gaaagaggcacccttccatctgattccagcac

SEQ ID NO: 17984 - DNA, 24 bp, Homo sapiens
tcacacctgtcatcccagcacttt

SEQ ID NO: 17985 - DNA, 32 bp, Homo sapiens
gaacctgggaggcagaggttgcagtgagctca

SEQ ID NO: 17986 - DNA, 32 bp, Homo sapiens
tcagattttcaaggccttaacaaagttaaagg

SEQ ID NO: 17987 - DNA, 32 bp, Homo sapiens
tgctgccatcttctctccccaccaccctttca

SEQ ID NO: 17988 - DNA, 32 bp, Homo sapiens
tgctgtaggagttgaacatctttgccagctcc

SEQ ID NO: 17989 - DNA, 24 bp, Homo sapiens
tcacacctgtaatcccagaacttt

SEQ ID NO: 17990 - DNA, 32 bp, Homo sapiens
acagtgttgctgctggcagagatgcattccag

SEQ ID NO: 17991 - DNA, 21 bp, Homo sapiens
caggagcccaggggatgggaa

SEQ ID NO: 17992 - DNA, 32 bp, Homo sapiens
gcttttagatgagacatctttccaggagtaga

SEQ ID NO: 17993 - DNA, 32 bp, Homo sapiens
agcctcctgagtagctgggaccacaggcgagt

SEQ ID NO: 17994 - DNA, 32 bp, Homo sapiens
tgcttgaatgttcttggaggctgtttcttatg

SEQ ID NO: 17995 - DNA, 32 bp, Homo sapiens
agaattaggggccttgaaaatatgacaaactc

SEQ ID NO: 17996 - DNA, 32 bp, Homo sapiens
gagcttaggaggttgaggctgcagtgagctgt

SEQ ID NO: 17997 - DNA, 28 bp, Homo sapiens
gggaggctcagggctgcctcctcgagtt

SEQ ID NO: 17998 - DNA, 32 bp, Homo sapiens
ccccgctctgcaggccgcccttctgccagctg

SEQ ID NO: 17999 - DNA, 24 bp, Homo sapiens
tcacgccagtaatcccagcacttt

SEQ ID NO: 18000 - DNA, 32 bp, Homo sapiens
catcttaatttccaaggaaactatatttctta

SEQ ID NO: 18001 - DNA, 32 bp, Homo sapiens
actctacctacttgaaaccacagggttgtggg

SEQ ID NO: 18002 - DNA, 32 bp, Homo sapiens
tttcccccagttttggtctgtgacacatttgg

SEQ ID NO: 18003 - DNA, 32 bp, Homo sapiens
aagaaggtgcctgcttctcttttgccttctac

SEQ ID NO: 18004 - DNA, 32 bp, Homo sapiens
gccaagctacctgaaattggaataagggggtg

SEQ ID NO: 18005 - DNA, 32 bp, Homo sapiens
ggatttgtgctgctgctgttattcaaagatca

SEQ ID NO: 18006 - DNA, 32 bp, Homo sapiens
caatggattgtgctgctctcgtttcagctttg

SEQ ID NO: 18007 - DNA, 32 bp, Homo sapiens
agtttgtcacccaggctggagtgctgtggtgt

SEQ ID NO: 18008 - DNA, 32 bp, Homo sapiens
tccccttgcctgaatctggagtggggttgagc

SEQ ID NO: 18009 - DNA, 32 bp, Homo sapiens
ggcaggaatgacaggagatgagcttgagggac

SEQ ID NO: 18010 - DNA, 32 bp, Homo sapiens
ttgccagggaccaggagctctcactttgccta

SEQ ID NO: 18011 - DNA, 32 bp, Homo sapiens
agcctcccaagtagctgggattacaggcgtgc

SEQ ID NO: 18012 - DNA, 32 bp, Homo sapiens
ctctgtcaaccaggctggagtgcagtgactct

SEQ ID NO: 18013 - DNA, 32 bp, Homo sapiens
gaatgtattactttgttctcccatgaaagaat

SEQ ID NO: 18014 - DNA, 32 bp, Homo sapiens
aatacgcactccagatgcctggaacaccattg

SEQ ID NO: 18015 - DNA, 32 bp, Homo sapiens
acctccgcctcctgggttaaagtgattctctc

SEQ ID NO: 18016 - DNA, 32 bp, Homo sapiens
ggagtatcagttctgagccacagatgaggaaa

SEQ ID NO: 18017 - DNA, 32 bp, Homo sapiens
aaagagagcgtgcctcaggttacttgaacttg

SEQ ID NO: 18018 - DNA, 32 bp, Homo sapiens
ctgttcgggaggctgaggcaggagaatcactt

SEQ ID NO: 18019 - DNA, 32 bp, Homo sapiens
agcctccccagtagctgggattacaggctcat

SEQ ID NO: 18020 - DNA, 32 bp, Homo sapiens
ctctatcacccaggctggagtgcagtgtggct

SEQ ID NO: 18021 - DNA, 32 bp, Homo sapiens
tgtccaaagtcccaggcccagtgcagtccttg

SEQ ID NO: 18022 - DNA, 32 bp, Homo sapiens
tccagatgtggtcaacttctggaacactcgct

SEQ ID NO: 18023 - DNA, 32 bp, Homo sapiens
acctccgcctcctgggttcaaacaattctgtc

SEQ ID NO: 18024 - DNA, 32 bp, Homo sapiens
gaacccgagaggcggagcttgcagtgagctga

SEQ ID NO: 18025 - DNA, 32 bp, Homo sapiens
gagcccaggaggtggaggctgcagtgagccat

SEQ ID NO: 18026 - DNA, 32 bp, Homo sapiens
cttcgccctgacacctgcttctaatgagaaat

SEQ ID NO: 18027 - DNA, 32 bp, Homo sapiens
ctcacacactctttttcccttctgccttcacc

SEQ ID NO: 18028 - DNA, 32 bp, Homo sapiens
atctgtcactcagcttctctgtgtctctggtt

SEQ ID NO: 18029 - DNA, 32 bp, Homo sapiens
aaaccttatagagtgagattatcatgtacaag

SEQ ID NO: 18030 - DNA, 32 bp, Homo sapiens
aggcctcagggtgtctgggattgctggggagg

SEQ ID NO: 18031 - DNA, 32 bp, Homo sapiens
agtctgttgcccaggctggagtgcagtggcgc

SEQ ID NO: 18032 - DNA, 32 bp, Homo sapiens
ctctgtactggaggctctgttctgcctcttat

SEQ ID NO: 18033 - DNA, 32 bp, Homo sapiens
cccagctggagcaattctcctgcctcagcctt

SEQ ID NO: 18034 - DNA, 32 bp, Homo sapiens
tggctcacgcctgtattccagcactttgggag

SEQ ID NO: 18035 - DNA, 32 bp, Homo sapiens
caggagggtgatgggagctctccaatttagtt

SEQ ID NO: 18036 - DNA, 32 bp, Homo sapiens
cctatctgacccatctgctcccaccgaagtta

SEQ ID NO: 18037 - DNA, 32 bp, Homo sapiens
ttggaagacatggatttcctggaagacgtgga

SEQ ID NO: 18038 - DNA, 32 bp, Homo sapiens
acctccgccccctgggttcaagcaattctcct

SEQ ID NO: 18039 - DNA, 32 bp, Homo sapiens
gtaaaagccctcttttctgttttcaggttttt

SEQ ID NO: 18040 - DNA, 32 bp, Homo sapiens
tatttgagctccgggtctcttctacctgcatt

SEQ ID NO: 18041 - DNA, 32 bp, Homo sapiens
ctactcgggaggctgagtcaggagaatcactt

SEQ ID NO: 18042 - DNA, 32 bp, Homo sapiens
ggtctttcacccaggctggagtgctgtggcac

SEQ ID NO: 18043 - DNA, 32 bp, Homo sapiens
tatagggtcgagcctaggggagcttgagggag

SEQ ID NO: 18044 - DNA, 32 bp, Homo sapiens
gaatgacacagctgctgtgcagctccacttcg

SEQ ID NO: 18045 - DNA, 32 bp, Homo sapiens
ggatgaagtctaccattaccagctgggtcacc

SEQ ID NO: 18046 - DNA, 32 bp, Homo sapiens
agcctcccaagtagctgggattacaggtgcct

SEQ ID NO: 18047 - DNA, 32 bp, Homo sapiens
aggagattgcccaggatcaagggtgcggtgtt

SEQ ID NO: 18048 - DNA, 32 bp, Homo sapiens
acctctgcctccctggttcaagcgattcttct

SEQ ID NO: 18049 - DNA, 32 bp, Homo sapiens
gagcccaggagtttgaggctgcagtgagctgt

SEQ ID NO: 18050 - DNA, 32 bp, Homo sapiens
gagcccgggaggcggagcttacagtgagctga

SEQ ID NO: 18051 - DNA, 32 bp, Homo sapiens
acctccgcctccctggttcaagcgattctcct

SEQ ID NO: 18052 - DNA, 31 bp, Homo sapiens
tttcagagaaacacaacggagggaaggagcc

SEQ ID NO: 18053 - DNA, 16 bp, Homo sapiens
gccatcctgtccaggt

SEQ ID NO: 18054 - DNA, 32 bp, Homo sapiens
ggagggagaagggaagaaagaaacaatgtcta

SEQ ID NO: 18055 - DNA, 32 bp, Homo sapiens
cccccgactgtgctgctcgcgaaggtcccaca

SEQ ID NO: 18056 - DNA, 32 bp, Homo sapiens
aagagggagccggtttgggagagaccattgca

SEQ ID NO: 18057 - DNA, 23 bp, Homo sapiens
cgccgtccgccccagccccgggg

SEQ ID NO: 18058 - DNA, 32 bp, Homo sapiens
gaagagaggttaggtaaagagagtttggagga

SEQ ID NO: 18059 - DNA, 24 bp, Homo sapiens
cagaccttctccctgaacttaaga

SEQ ID NO: 18060 - DNA, 32 bp, Homo sapiens
gctcgttacccagggtggagtgcagtggtagc

SEQ ID NO: 18061 - DNA, 32 bp, Homo sapiens
tcctgaagcccaacgatggaccattctcaccc

SEQ ID NO: 18062 - DNA, 32 bp, Homo sapiens
ggcctcccaaaatgctgggattacatgcatga

SEQ ID NO: 18063 - DNA, 32 bp, Homo sapiens
agcctcctgtgtagctgggattatagattgga

SEQ ID NO: 18064 - DNA, 32 bp, Homo sapiens
attgggatgggtggagaaagacgacaagagag

SEQ ID NO: 18065 - DNA, 32 bp, Homo sapiens
cagggcgggaggcaggctgtgtcctcggtggg

SEQ ID NO: 18066 - DNA, 32 bp, Homo sapiens
gaacctgggaggcagaggttgcagtgaaccta

SEQ ID NO: 18067 - DNA, 32 bp, Homo sapiens
atttgacagctttccttggtgacccaaacctt

SEQ ID NO: 18068 - DNA, 32 bp, Homo sapiens
agagtctccttctcttctcttctttgggatgc

SEQ ID NO: 18069 - DNA, 32 bp, Homo sapiens
cgtggactgcggccacagcttctgcctcaggt

SEQ ID NO: 18070 - DNA, 32 bp, Homo sapiens
gctctgtcacccaggctggagtgccgtggcac

SEQ ID NO: 18071 - DNA, 23 bp, Homo sapiens
tggcacagtcttggctcactgca

SEQ ID NO: 18072 - DNA, 32 bp, Homo sapiens
tgggtcttagcattgatcagtgacacacctct

SEQ ID NO: 18073 - DNA, 32 bp, Homo sapiens
ctgggttcaagcaatcctcccacctcggcctc

SEQ ID NO: 18074 - DNA, 32 bp, Homo sapiens
ttctgtggcccaggctggagtgcagtggctgt

SEQ ID NO: 18075 - DNA, 32 bp, Homo sapiens
gctctgtctcccaggccggagtgcagtggcac

SEQ ID NO: 18076 - DNA, 32 bp, Homo sapiens
gcctccacctcccaggttcaagcgattctcct

SEQ ID NO: 18077 - DNA, 32 bp, Homo sapiens
cagatctacagctcctggataattgcttgatt

SEQ ID NO: 18078 - DNA, 32 bp, Homo sapiens
ctccccatgtttctccccactagaagcctccg

SEQ ID NO: 18079 - DNA, 24 bp, Homo sapiens
tcacgcctgtaatcccaacatttt

SEQ ID NO: 18080 - DNA, 32 bp, Homo sapiens
cttcccccagttcatcaaagcctacaagacgg

SEQ ID NO: 18081 - DNA, 32 bp, Homo sapiens
gtgaccttattgctgctcagactctatgttcc

SEQ ID NO: 18082 - DNA, 20 bp, Homo sapiens
ggaccgctggacagacgcac

SEQ ID NO: 18083 - DNA, 32 bp, Homo sapiens
gtgtttgctgggcactatgctaagcactttgg

SEQ ID NO: 18084 - DNA, 32 bp, Homo sapiens
aaagaagctcgggctgccatgtggaaaagaat

SEQ ID NO: 18085 - DNA, 32 bp, Homo sapiens
gctctatcacccaggctgaagtgcagtggtac

SEQ ID NO: 18086 - DNA, 28 bp, Homo sapiens
gggatgcccaggaacgcctcatctcagc

SEQ ID NO: 18087 - DNA, 32 bp, Homo sapiens
gacagagggagaggagaagagacgcaaaagac

SEQ ID NO: 18088 - DNA, 32 bp, Homo sapiens
gaacccaggatgcggaggttgcagtgagccga

SEQ ID NO: 18089 - DNA, 32 bp, Homo sapiens
tcatcctggagtaccttcctggaccactctct

SEQ ID NO: 18090 - DNA, 19 bp, Homo sapiens
ggcaggtgcacacacctcc

SEQ ID NO: 18091 - DNA, 32 bp, Homo sapiens
gcacggcctcaaggtagtgaggctaggaggtt

SEQ ID NO: 18092 - DNA, 32 bp, Homo sapiens
ttcactttgcagcctcctcttctgtcaccaac

SEQ ID NO: 18093 - DNA, 32 bp, Homo sapiens
gctctgtccgccaggctggagtgcagtggcgc

SEQ ID NO: 18094 - DNA, 32 bp, Homo sapiens
tcccggccattctccctcttgttttcacttca

SEQ ID NO: 18095 - DNA, 32 bp, Homo sapiens
tgcactgtgctgctctcacagatcggtgtctg

SEQ ID NO: 18096 - DNA, 32 bp, Homo sapiens
ctgggctcaagcaattctcatgtctcagcctc

SEQ ID NO: 18097 - DNA, 32 bp, Homo sapiens
ctcagcctgagtagctgggactacaggtgtgt

SEQ ID NO: 18098 - DNA, 32 bp, Homo sapiens
tggggaggtctggatggatctgtgtaggagtt

SEQ ID NO: 18099 - DNA, 23 bp, Homo sapiens
tcaggcctgtaaccccagcactt

SEQ ID NO: 18100 - DNA, 17 bp, Homo sapiens
aggtaaattgtcctgaa

SEQ ID NO: 18101 - DNA, 32 bp, Homo sapiens
acctccgcctcctgggtccaagtgattctcct

SEQ ID NO: 18102 - DNA, 32 bp, Homo sapiens
gactgggcggtgattccgcttctgcctgggct

SEQ ID NO: 18103 - DNA, 32 bp, Homo sapiens
gtgcagcctcgtgcagctcttctggtctccgg

SEQ ID NO: 18104 - DNA, 32 bp, Homo sapiens
gtaaggcattggagaaggacaatgtaaaagac

SEQ ID NO: 18105 - DNA, 32 bp, Homo sapiens
agaatgtcagttctgttttaagtaacagaatt

SEQ ID NO: 18106 - DNA, 32 bp, Homo sapiens
tgtgatgctgctggttttatctctagtgaaat

SEQ ID NO: 18107 - DNA, 21 bp, Homo sapiens
gggccacagcttaaacagctt

SEQ ID NO: 18108 - DNA, 32 bp, Homo sapiens
gctctgtcatgcaggctggagtgcggtggtgc

SEQ ID NO: 18109 - DNA, 32 bp, Homo sapiens
actctgctgcctaggctgagtgcagtggtgtg

SEQ ID NO: 18110 - DNA, 32 bp, Homo sapiens
cttgggaccagaagagaaagaaccaaaaagtg

SEQ ID NO: 18111 - DNA, 32 bp, Homo sapiens
agtacctcttgagttaattttctgcctccagt

SEQ ID NO: 18112 - DNA, 17 bp, Homo sapiens
gcagaaacatgctttcc

SEQ ID NO: 18113 - DNA, 32 bp, Homo sapiens
agaccctattaaagaaaccacagggtttgatt

SEQ ID NO: 18114 - DNA, 32 bp, Homo sapiens
ccatcccctctacctgcagacagggtcggagg

SEQ ID NO: 18115 - DNA, 32 bp, Homo sapiens
cacttttgcccaggctggagtgcagtggcgtg

SEQ ID NO: 18116 - DNA, 32 bp, Homo sapiens
agaagagaaaggtgagaaagaagaggaagata

SEQ ID NO: 18117 - DNA, 24 bp, Homo sapiens
acaagcaccagccaccatgcctgg

SEQ ID NO: 18118 - DNA, 32 bp, Homo sapiens
actctgtggcccaggctggagtgcagtggcgc

SEQ ID NO: 18119 - DNA, 32 bp, Homo sapiens
tgctcctcacccaggctggaatgcagtggtgt

SEQ ID NO: 18120 - DNA, 32 bp, Homo sapiens
ttgctctgttgccaagttaagtgcagtggtat

SEQ ID NO: 18121 - DNA, 32 bp, Homo sapiens
ggcgggaaggggcagaggccgtgagctctcag

SEQ ID NO: 18122 - DNA, 32 bp, Homo sapiens
caccctgaagatgacttcctgagccagccccc

SEQ ID NO: 18123 - DNA, 28 bp, Homo sapiens
atcacctggggtgctgcctctcacacat

SEQ ID NO: 18124 - DNA, 32 bp, Homo sapiens
gctcttctctccttctctcttctcttcttctt

SEQ ID NO: 18125 - DNA, 32 bp, Homo sapiens
ttttatgccatctgtctcaaatcaaagagtca

SEQ ID NO: 18126 - DNA, 32 bp, Homo sapiens
tgagcccagaggtagaggctgcagtgagccat

SEQ ID NO: 18127 - DNA, 23 bp, Homo sapiens
ctgctgctgactctgtgcagctg

SEQ ID NO: 18128 - DNA, 24 bp, Homo sapiens
tgacacagtctcagctcactgcag

SEQ ID NO: 18129 - DNA, 24 bp, Homo sapiens
tgacacagttgcagctcactgcag

SEQ ID NO: 18130 - DNA, 32 bp, Homo sapiens
ggcctcccaaagtgctgggatttcaggcgtga

SEQ ID NO: 18131 - DNA, 32 bp, Homo sapiens
cgtgaggaaggcgcagctctgtggaaaggtca

SEQ ID NO: 18132 - DNA, 32 bp, Homo sapiens
ctttgacccccaggctggagtgcagtggcacg

SEQ ID NO: 18133 - DNA, 32 bp, Homo sapiens
accactctctcctgggttcaagtgattctcct

SEQ ID NO: 18134 - DNA, 28 bp, Homo sapiens
gtatcatgcagtgctgccctcatcctcc

SEQ ID NO: 18135 - DNA, 32 bp, Homo sapiens
ggttgcagtgagctgaggttgcggtgagctga

SEQ ID NO: 18136 - DNA, 32 bp, Homo sapiens
gtgagccaccacgcctgggcccatgaaccaag

SEQ ID NO: 18137 - DNA, 32 bp, Homo sapiens
ttgggccagtacgacttctaaggaatcatagt

SEQ ID NO: 18138 - DNA, 32 bp, Homo sapiens
tcccgggcacttctccccacctcggccccgcg

SEQ ID NO: 18139 - DNA, 24 bp, Homo sapiens
tcatgcctgtagtcccagcactcg

SEQ ID NO: 18140 - DNA, 32 bp, Homo sapiens
gaaccccggaggcggaggttgcagtgagctga

SEQ ID NO: 18141 - DNA, 19 bp, Homo sapiens
gccaggcggccatccagaa

SEQ ID NO: 18142 - DNA, 32 bp, Homo sapiens
tgccacctgagaggagcttctgtttggcattc

SEQ ID NO: 18143 - DNA, 20 bp, Homo sapiens
ggtggctgcgtgtggtggct

SEQ ID NO: 18144 - DNA, 32 bp, Homo sapiens
gttaactccttagtttcagaccacagactcaa

SEQ ID NO: 18145 - DNA, 32 bp, Homo sapiens
ccggcctagttaccgtcataccacgggaggag

SEQ ID NO: 18146 - DNA, 23 bp, Homo sapiens
acaggtgtgccaccacgcctggc

SEQ ID NO: 18147 - DNA, 32 bp, Homo sapiens
ctgtgtggcctaggttggagtgcaatggcgca

SEQ ID NO: 18148 - DNA, 32 bp, Homo sapiens
gctctgtcgccaggctgaagtgcagtggcgca

SEQ ID NO: 18149 - DNA, 32 bp, Homo sapiens
tcttgccgtccaggctggagtgcaatggcgtg

SEQ ID NO: 18150 - DNA, 32 bp, Homo sapiens
cctctcacagtcagtcctcccacccgagtgac

SEQ ID NO: 18151 - DNA, 32 bp, Homo sapiens
gaacctgggaggtggaagttgcagtgagccga

SEQ ID NO: 18152 - DNA, 28 bp, Homo sapiens
acagggccatgtgctgccctgttgccga

SEQ ID NO: 18153 - DNA, 32 bp, Homo sapiens
gtcagtcttccacgtgtaaacaacagtgtgtg

SEQ ID NO: 18154 - DNA, 23 bp, Homo sapiens
ctgtcgccaggctggaatgcagt

SEQ ID NO: 18155 - DNA, 32 bp, Homo sapiens
caatgtcatcttctccatgaagaccactgaat

SEQ ID NO: 18156 - DNA, 32 bp, Homo sapiens
tcctggggctggtgtctcaggagcaggggtct

SEQ ID NO: 18157 - DNA, 32 bp, Homo sapiens
agagcgacttcttttgctatgagtaatacatt

SEQ ID NO: 18158 - DNA, 32 bp, Homo sapiens
ctcattgcagaactttatccctggaagccttc

SEQ ID NO: 18159 - DNA, 32 bp, Homo sapiens
ttaagcaaggaacttgtcaagagatcatggtt

SEQ ID NO: 18160 - DNA, 32 bp, Homo sapiens
cagcccagcccaggcagcggggtggtggttgt

SEQ ID NO: 18161 - DNA, 32 bp, Homo sapiens
cactgtcgcccaatctggagtgcactggcgct

SEQ ID NO: 18162 - DNA, 32 bp, Homo sapiens
ctctgaacagttctgtctctactacctgatct

SEQ ID NO: 18163 - DNA, 28 bp, Homo sapiens
gctctgtcacccaggctggagtgcagtg

SEQ ID NO: 18164 - DNA, 28 bp, Homo sapiens
actctgtcgcccaggctggagtgcagtg

SEQ ID NO: 18165 - DNA, 32 bp, Homo sapiens
ctctgttgcccaggctgaagtgcagtggggcg

SEQ ID NO: 18166 - DNA, 32 bp, Homo sapiens
gaaccctaaaggcagaggttgcagtgagccga

SEQ ID NO: 18167 - DNA, 32 bp, Homo sapiens
aacctcgcctccctggttcaagcaattctcct

SEQ ID NO: 18168 - DNA, 32 bp, Homo sapiens
tacattcttcttaaagtccacaacagcagatt

SEQ ID NO: 18169 - DNA, 32 bp, Homo sapiens
ctccactctgcagcctcaaactcctgggctcc

SEQ ID NO: 18170 - DNA, 31 bp, Homo sapiens
tcatttgacaacacatgtgggagaggaggtc

SEQ ID NO: 18171 - DNA, 32 bp, Homo sapiens
caaaatgatttccaaagcagaacatggaactt

SEQ ID NO: 18172 - DNA, 32 bp, Homo sapiens
ctctgtctcctaggctggagcgcagtggtgca

SEQ ID NO: 18173 - DNA, 32 bp, Homo sapiens
aactggagctccatctttgctgctaggaaggc

SEQ ID NO: 18174 - DNA, 32 bp, Homo sapiens
tataaaatatattggcttttgttttcaatgtg

SEQ ID NO: 18175 - DNA, 32 bp, Homo sapiens
actctgtcgcccaggctggagtgcagtggtgc

SEQ ID NO: 18176 - DNA, 32 bp, Homo sapiens
cagctgcagtggttgggaggagcttgaccagt

SEQ ID NO: 18177 - DNA, 32 bp, Homo sapiens
tctttttacccaggctggagtgcaatgatgcg

SEQ ID NO: 18178 - DNA, 32 bp, Homo sapiens
gctctgttacccaggctggagtgtagtggtgc

SEQ ID NO: 18179 - DNA, 32 bp, Homo sapiens
actctgtcacccaggctggagtgcggtggtgc

SEQ ID NO: 18180 - DNA, 32 bp, Homo sapiens
gctctgtcacccaggttggagtgcagtggtgt

SEQ ID NO: 18181 - DNA, 32 bp, Homo sapiens
cgcctagaaaacttgctctcaaacttcagggt

SEQ ID NO: 18182 - DNA, 32 bp, Homo sapiens
gctctgtcacccaggctggagtgcagtggtgc

SEQ ID NO: 18183 - DNA, 32 bp, Homo sapiens
gctctgttacccaggctggagtgcagtggtgt

SEQ ID NO: 18184 - DNA, 32 bp, Homo sapiens
aaggactgcgagcacagtcagcactttggcag

SEQ ID NO: 18185 - DNA, 32 bp, Homo sapiens
tgtcgggagtcgggagtctccacgccgtgtga

SEQ ID NO: 18186 - DNA, 32 bp, Homo sapiens
gcttggcctctggctccatctgagtcccctgg

SEQ ID NO: 18187 - DNA, 32 bp, Homo sapiens
gcttcctgtaccatctactggaccgtgagcca

SEQ ID NO: 18188 - DNA, 32 bp, Homo sapiens
acctccacctactaggctcaagcaattctcgt

SEQ ID NO: 18189 - DNA, 28 bp, Homo sapiens
gtctgggcaagtgctccctcactccctt

SEQ ID NO: 18190 - DNA, 32 bp, Homo sapiens
caggggaagggtgggtggttgcaggggaagtt

SEQ ID NO: 18191 - DNA, 32 bp, Homo sapiens
tgggatggggcttgggagttgcagtgaatgtc

SEQ ID NO: 18192 - DNA, 32 bp, Homo sapiens
caaatcatatatcagtctgctcagttgaaacc

SEQ ID NO: 18193 - DNA, 32 bp, Homo sapiens
atgtagatatttctcttattgttttcatgtaa

SEQ ID NO: 18194 - DNA, 32 bp, Homo sapiens
aaactgttcatcctgaaacaggcacaggtgat

SEQ ID NO: 18195 - DNA, 31 bp, Homo sapiens
caagcatgtctgcaaattaggagggagttag

SEQ ID NO: 18196 - DNA, 32 bp, Homo sapiens
acaaggagaagaggaagggaggaagggaacag

SEQ ID NO: 18197 - DNA, 32 bp, Homo sapiens
ctcagatatacttggttctctccaccaggttc

SEQ ID NO: 18198 - DNA, 32 bp, Homo sapiens
taactaatcatatttaaatatatttcactttc

SEQ ID NO: 18199 - DNA, 23 bp, Homo sapiens
ggtgaggcaagaagctctgggga

SEQ ID NO: 18200 - DNA, 20 bp, Homo sapiens
catgtctcggctcactgtag

SEQ ID NO: 18201 - DNA, 17 bp, Homo sapiens
gccaccaccctcccaga

SEQ ID NO: 18202 - DNA, 20 bp, Homo sapiens
gccaggctggagtgcagtaa

SEQ ID NO: 18203 - DNA, 32 bp, Homo sapiens
cttggatctttttgcagactagctaattagct

SEQ ID NO: 18204 - DNA, 32 bp, Homo sapiens
tttagacagcgtttcgctcttgttgcccaggc

SEQ ID NO: 18205 - DNA, 32 bp, Homo sapiens
aaggatgactcagcagggatgattcagcagag

SEQ ID NO: 18206 - DNA, 32 bp, Homo sapiens
gctcacagcccaggcagggtgtgtggctcctg

SEQ ID NO: 18207 - DNA, 32 bp, Homo sapiens
ctccaggaagttttgagtttctctccaccgtg

SEQ ID NO: 18208 - DNA, 32 bp, Homo sapiens
ttgtaggatacttgctccattcatacacaacg

SEQ ID NO: 18209 - DNA, 32 bp, Homo sapiens
gctctgtcacccaggctgaagtgcagtggagc

SEQ ID NO: 18210 - DNA, 32 bp, Homo sapiens
aggaattcacccaggcagcctggagtcagcca

SEQ ID NO: 18211 - DNA, 32 bp, Homo sapiens
ctgtgttgcccagcctgggtgtcaataattat

SEQ ID NO: 18212 - DNA, 32 bp, Homo sapiens
aactccgcctcccgggttcaagcgattctcgt

SEQ ID NO: 18213 - DNA, 28 bp, Homo sapiens
cctgaccccagtgctgctctaagcaccg

SEQ ID NO: 18214 - DNA, 32 bp, Homo sapiens
tggagcaatttccagcagaagttgtggcttgc

SEQ ID NO: 18215 - DNA, 32 bp, Homo sapiens
tgtggactgaagaagaaagaaaacaattcaaa

SEQ ID NO: 18216 - DNA, 32 bp, Homo sapiens
ctgactctaggtgcccttggaggccagccagt

SEQ ID NO: 18217 - DNA, 32 bp, Homo sapiens
cagctccattggaggggacacatcactggctt

SEQ ID NO: 18218 - DNA, 24 bp, Homo sapiens
tcatgcctccaatcccagcacttt

SEQ ID NO: 18219 - DNA, 24 bp, Homo sapiens
tcacacctgtaatccccgcacttt

SEQ ID NO: 18220 - DNA, 23 bp, Homo sapiens
gaaagaagaaaagataataccca

SEQ ID NO: 18221 - DNA, 32 bp, Homo sapiens
agaccactcaaaacatgcttacactaacactt

SEQ ID NO: 18222 - DNA, 32 bp, Homo sapiens
tgtggctctgcagcccctgctcctttctgcgg

SEQ ID NO: 18223 - DNA, 32 bp, Homo sapiens
aaatgttttctaactcaactggccggcttcct

SEQ ID NO: 18224 - DNA, 32 bp, Homo sapiens
ttgagatggagtttcgctcttgtcacccacgc

SEQ ID NO: 18225 - DNA, 32 bp, Homo sapiens
gtgtatcaagtgtcgctcacagccccattcac

SEQ ID NO: 18226 - DNA, 32 bp, Homo sapiens
cagcctctgagtagctgggattacaggcacac

SEQ ID NO: 18227 - DNA, 32 bp, Homo sapiens
agcctcctagagtgctgggattacagacatga

SEQ ID NO: 18228 - DNA, 32 bp, Homo sapiens
agcctaccaagtagctgggattacaggtgtgt

SEQ ID NO: 18229 - DNA, 32 bp, Homo sapiens
gaacccgggtggcagaggttgcagtgagccga

SEQ ID NO: 18230 - DNA, 32 bp, Homo sapiens
ctgggttcaagcagttctcccgcctcagcctc

SEQ ID NO: 18231 - DNA, 32 bp, Homo sapiens
ccattcaggacataggcacaggcaaagatttc

SEQ ID NO: 18232 - DNA, 32 bp, Homo sapiens
ggaaacctccctttacagcaccaccttgcgat

SEQ ID NO: 18233 - DNA, 21 bp, Homo sapiens
tcacgcctataatctcagcac

SEQ ID NO: 18234 - DNA, 32 bp, Homo sapiens
ccaggcgggtttctgtcaggcccggggaggag

SEQ ID NO: 18235 - DNA, 23 bp, Homo sapiens
tggcacgatcttggctcactcca

SEQ ID NO: 18236 - DNA, 32 bp, Homo sapiens
ttgtctctcgctgcagtcgcagctccaggtct

SEQ ID NO: 18237 - DNA, 32 bp, Homo sapiens
caattcaggaatcaagggctgtggagaaactc

SEQ ID NO: 18238 - DNA, 32 bp, Homo sapiens
ctcgaggaccgaggcctgctgtggaggacacc

SEQ ID NO: 18239 - DNA, 32 bp, Homo sapiens
ctccaaagtgtgagttcctctgatctcttgat

SEQ ID NO: 18240 - DNA, 32 bp, Homo sapiens
tccagctctgcagcagttgtctcctaatgtga

SEQ ID NO: 18241 - DNA, 24 bp, Homo sapiens
tcatgcctgtaaacccagcacttt

SEQ ID NO: 18242 - DNA, 32 bp, Homo sapiens
ctgacctcaggtgttccacccacctcagcctt

SEQ ID NO: 18243 - DNA, 32 bp, Homo sapiens
ctcactcatccctttggcccacaggtacatgt

SEQ ID NO: 18244 - DNA, 32 bp, Homo sapiens
cctctccccaaaatattcccatcttgtcctag

SEQ ID NO: 18245 - DNA, 32 bp, Homo sapiens
agctactcagggacttctcttgcctggagggt

SEQ ID NO: 18246 - DNA, 32 bp, Homo sapiens
cagaggtgcacaggctggagtttcaggcactg

SEQ ID NO: 18247 - DNA, 32 bp, Homo sapiens
tctatggatacttgggttgtgggggctctctt

SEQ ID NO: 18248 - DNA, 20 bp, Homo sapiens
cagggagggtcctccagctc

SEQ ID NO: 18249 - DNA, 32 bp, Homo sapiens
tacctgtcccttggctatgagcaggctttggg

SEQ ID NO: 18250 - DNA, 32 bp, Homo sapiens
cgccaaggggttcgtgcgctgtggagacgcgg

SEQ ID NO: 18251 - DNA, 32 bp, Homo sapiens
ccccaggttggagtgcagtggcgtgtcttggg

SEQ ID NO: 18252 - DNA, 32 bp, Homo sapiens
acattatcagaacttaagtcctggagatcaga

SEQ ID NO: 18253 - DNA, 21 bp, Homo sapiens
ggcaaatgctgaatattctcc

SEQ ID NO: 18254 - DNA, 32 bp, Homo sapiens
gaacccgggaggcagaggttgcagtgaaccca

SEQ ID NO: 18255 - DNA, 32 bp, Homo sapiens
ctctgtcacccaggctggagtgctatggctcg

SEQ ID NO: 18256 - DNA, 32 bp, Homo sapiens
ctccatcacccaagccagagtgcagtggtgaa

SEQ ID NO: 18257 - DNA, 32 bp, Homo sapiens
ctgtgcctgctccttatgagtgcagtggaagg

SEQ ID NO: 18258 - DNA, 32 bp, Homo sapiens
ctcttgttgcccaggctggagtgcaatggcat

SEQ ID NO: 18259 - DNA, 32 bp, Homo sapiens
gctctttcgcccaggccggactgcagtggcgc

SEQ ID NO: 18260 - DNA, 32 bp, Homo sapiens
ttctgtcactcaggctggagtacagtggtgcc

SEQ ID NO: 18261 - DNA, 32 bp, Homo sapiens
ctgacctcaggtgattcacccacctcagcttc

SEQ ID NO: 18262 - DNA, 32 bp, Homo sapiens
ctcttgttgcccaggctggagtacaatggcgt

SEQ ID NO: 18263 - DNA, 32 bp, Homo sapiens
ctcttgttgcccaggttagagtgcagtggcac

SEQ ID NO: 18264 - DNA, 32 bp, Homo sapiens
ctaccctcttcctgggaaagtaattgctgagc

SEQ ID NO: 18265 - DNA, 32 bp, Homo sapiens
gtcacctcctctcaggttcaagtgattctcct

SEQ ID NO: 18266 - DNA, 32 bp, Homo sapiens
gtcttggactcctggcctcaagcaatcctccc

SEQ ID NO: 18267 - DNA, 32 bp, Homo sapiens
gcagctaagcagtcttctcttctgcctttatg

SEQ ID NO: 18268 - DNA, 32 bp, Homo sapiens
tgtgcagctgactgtctcagccaaaccactga

SEQ ID NO: 18269 - DNA, 32 bp, Homo sapiens
gaatcggggaggcagagcttgcagtcagccga

SEQ ID NO: 18270 - DNA, 32 bp, Homo sapiens
ctcttgtcgctcagcctggagtgcagtgagct

SEQ ID NO: 18271 - DNA, 32 bp, Homo sapiens
ggagaggggagaggagagagtttgggaaaggg

SEQ ID NO: 18272 - DNA, 19 bp, Homo sapiens
tctcaccttgttcatttca

SEQ ID NO: 18273 - DNA, 32 bp, Homo sapiens
actgtccctagtagttgggattacaggcacat

SEQ ID NO: 18274 - DNA, 32 bp, Homo sapiens
agccttccaagtagctgggattacaagtgccc

SEQ ID NO: 18275 - DNA, 32 bp, Homo sapiens
tgaagggcttcaggctgggggcagtggacagg

SEQ ID NO: 18276 - DNA, 32 bp, Homo sapiens
agctgtgttccctgtctcaggtcaagcagtgg

SEQ ID NO: 18277 - DNA, 32 bp, Homo sapiens
aggaaagaaagaaagaaaagaaaagaaaatcc

SEQ ID NO: 18278 - DNA, 32 bp, Homo sapiens
tatctgtcaaaccatttctgttagaacgatgt

SEQ ID NO: 18279 - DNA, 32 bp, Homo sapiens
ctctgtctcctaagctggagtgcagtggcatc

SEQ ID NO: 18280 - DNA, 26 bp, Homo sapiens
aatgtcaggaatggaagccactgtga

SEQ ID NO: 18281 - DNA, 32 bp, Homo sapiens
ctcccagccctctttgccggacgagctctggg

SEQ ID NO: 18282 - DNA, 32 bp, Homo sapiens
ccggcgaagacgccttcctggggtactgagcc

SEQ ID NO: 18283 - DNA, 28 bp, Homo sapiens
gacctccaagctcctgcctcaccgtctg

SEQ ID NO: 18284 - DNA, 32 bp, Homo sapiens
ggcggcggaggaggagaaaggaaagaggaagg

SEQ ID NO: 18285 - DNA, 32 bp, Homo sapiens
acaggcacggctggtggtgtgcagtgaacagc

SEQ ID NO: 18286 - DNA, 32 bp, Homo sapiens
gagcctgggagatggaggttgcagtgagctga

SEQ ID NO: 18287 - DNA, 18 bp, Homo sapiens
ggtggctgggaggtggct

SEQ ID NO: 18288 - DNA, 32 bp, Homo sapiens
agaatttagtttgtactcagtggacagtgctg

SEQ ID NO: 18289 - DNA, 32 bp, Homo sapiens
ggccaggtgttctcctggggcgggggcaggca

SEQ ID NO: 18290 - DNA, 32 bp, Homo sapiens
cctcaggaagcttggcttccctcccatgggaa

SEQ ID NO: 18291 - DNA, 21 bp, Homo sapiens
ccctggggcgcaaacattccc

SEQ ID NO: 18292 - DNA, 24 bp, Homo sapiens
ctgtagcccagtctggagtgcagt

SEQ ID NO: 18293 - DNA, 32 bp, Homo sapiens
ggcttcccaagtagctgggattacaggcacgt

SEQ ID NO: 18294 - DNA, 32 bp, Homo sapiens
ctgtattgcccaggctggagtgcagtggcgcg

SEQ ID NO: 18295 - DNA, 32 bp, Homo sapiens
atattgccattatgcttgacatggtttccaaa

SEQ ID NO: 18296 - DNA, 32 bp, Homo sapiens
acctccgcctcccaggttcaagcaattctccc

SEQ ID NO: 18297 - DNA, 32 bp, Homo sapiens
gcctccgtctcccaggttcaagcagttctcct

SEQ ID NO: 18298 - DNA, 32 bp, Homo sapiens
ctgtgagatcttctccacctagtctgccctaa

SEQ ID NO: 18299 - DNA, 16 bp, Homo sapiens
gcccttgttgcccagg

SEQ ID NO: 18300 - DNA, 32 bp, Homo sapiens
cactttgggaggcagagacaggtggatcacga

SEQ ID NO: 18301 - DNA, 32 bp, Homo sapiens
tccttgtgtccctcgtcccacaggaggacaca

SEQ ID NO: 18302 - DNA, 22 bp, Homo sapiens
gggacagtgcagagcaccgggg

SEQ ID NO: 18303 - DNA, 32 bp, Homo sapiens
gatgatcctaacctgcagcacggtggttttac

SEQ ID NO: 18304 - DNA, 32 bp, Homo sapiens
tttaccacctcaacaggaacattgacttgttt

SEQ ID NO: 18305 - DNA, 32 bp, Homo sapiens
tcgcccaggccaggctgtggcagatgagccgt

SEQ ID NO: 18306 - DNA, 22 bp, Homo sapiens
caggaaagccagattccagcct

SEQ ID NO: 18307 - DNA, 32 bp, Homo sapiens
cctgcctcagctgcatctgataaagttgagag

SEQ ID NO: 18308 - DNA, 32 bp, Homo sapiens
cctgccgactcctgggttgagctgttgcctca

SEQ ID NO: 18309 - DNA, 32 bp, Homo sapiens
atcattcacagtgccctccccacagcactacc

SEQ ID NO: 18310 - DNA, 32 bp, Homo sapiens
aagataaatacttggctaatcttccatttaca

SEQ ID NO: 18311 - DNA, 23 bp, Homo sapiens
tggcatgatctcgactcactgca

SEQ ID NO: 18312 - DNA, 32 bp, Homo sapiens
gaacccgggaggcagagcttgcagtgagtcga

SEQ ID NO: 18313 - DNA, 32 bp, Homo sapiens
tcttgttgcccaggctggaaatggcgcgatct

SEQ ID NO: 18314 - DNA, 32 bp, Homo sapiens
ttcatattcgttaataaactttgctactttgc

SEQ ID NO: 18315 - DNA, 32 bp, Homo sapiens
ctaacatccagaatctcataccacagactggt

SEQ ID NO: 18316 - DNA, 32 bp, Homo sapiens
agcctcctgagtagctgggaccacaggcgact

SEQ ID NO: 18317 - DNA, 32 bp, Homo sapiens
gacaaagaatccctctgttcactgtggtggga

SEQ ID NO: 18318 - DNA, 32 bp, Homo sapiens
cgtgcgcgcccaggccagtgctgtgagcaggc

SEQ ID NO: 18319 - DNA, 32 bp, Homo sapiens
ctgggctcaagcaatcagcccacctctgcctc

SEQ ID NO: 18320 - DNA, 32 bp, Homo sapiens
ccagtttcaagcaattctcatgcctcagattc

SEQ ID NO: 18321 - DNA, 32 bp, Homo sapiens
gcttcctacctgcagcttcactttgctctagt

SEQ ID NO: 18322 - DNA, 32 bp, Homo sapiens
gggaggtcctgagtgaggaaggcatgacctct

SEQ ID NO: 18323 - DNA, 32 bp, Homo sapiens
acctccacctcctgggttcaagcaattctcct

SEQ ID NO: 18324 - DNA, 32 bp, Homo sapiens
aactcctcaagcaaaatttctgttcattttac

SEQ ID NO: 18325 - DNA, 32 bp, Homo sapiens
tctgattattggagacagaagtcctgtcactt

SEQ ID NO: 18326 - DNA, 31 bp, Homo sapiens
gaaggcaacaacatatagagggtggaagaat

SEQ ID NO: 18327 - DNA, 19 bp, Homo sapiens
gcccccaccctgcctggtg

SEQ ID NO: 18328 - DNA, 32 bp, Homo sapiens
ttgtaagcagaactctagctatatggggtaga

SEQ ID NO: 18329 - DNA, 21 bp, Homo sapiens
cagtcggtcttcctccggccc

SEQ ID NO: 18330 - DNA, 32 bp, Homo sapiens
gatggcagcccagggtcacaggcataggataa

SEQ ID NO: 18331 - DNA, 32 bp, Homo sapiens
aacaagaaataaaaggtgttgtggaaacttaa

SEQ ID NO: 18332 - DNA, 32 bp, Homo sapiens
ttgaaactggttggggaatgaggtgataagca

SEQ ID NO: 18333 - DNA, 32 bp, Homo sapiens
ggattagggacctaccaaaatatttcattaat

SEQ ID NO: 18334 - DNA, 32 bp, Homo sapiens
aattagtggacagactccctggaacatgtttg

SEQ ID NO: 18335 - DNA, 22 bp, Homo sapiens
gccactgatcctgcaacttgct

SEQ ID NO: 18336 - DNA, 32 bp, Homo sapiens
aaaccctggaggcagaggttgcagtgagccaa

SEQ ID NO: 18337 - DNA, 32 bp, Homo sapiens
aaacccaggaggcagagcttgcagtgagccga

SEQ ID NO: 18338 - DNA, 32 bp, Homo sapiens
ttcctctagcctctgctggagtgcagtgagga

SEQ ID NO: 18339 - DNA, 23 bp, Homo sapiens
tggcacgatctcggttcactgca

SEQ ID NO: 18340 - DNA, 32 bp, Homo sapiens
cttggagcagctcctctgcaggcacagcctgg

SEQ ID NO: 18341 - DNA, 32 bp, Homo sapiens
agcaatccaagtgatcctcccacctcaacctt

SEQ ID NO: 18342 - DNA, 32 bp, Homo sapiens
gccaggtgtactctgcgccccacgctggaaaa

SEQ ID NO: 18343 - DNA, 32 bp, Homo sapiens
ccagacagtctacaactgccccctccagccca

SEQ ID NO: 18344 - DNA, 32 bp, Homo sapiens
tgttgtcccagtgccctggttcagtgtctcct

SEQ ID NO: 18345 - DNA, 23 bp, Homo sapiens
tcacacctataatcgagcacttt

SEQ ID NO: 18346 - DNA, 20 bp, Homo sapiens
cttcctgtccctgccttcga

SEQ ID NO: 18347 - DNA, 28 bp, Homo sapiens
ttttcaccaaaatgagcctcatcccttt

SEQ ID NO: 18348 - DNA, 32 bp, Homo sapiens
gcagccctcgacaacaaatacagggtctgttg

SEQ ID NO: 18349 - DNA, 32 bp, Homo sapiens
tagagcgtctcagcatcgccagtctagactgt

SEQ ID NO: 18350 - DNA, 32 bp, Homo sapiens
cctcttctgcgtgcccctcttctgtctcatag

SEQ ID NO: 18351 - DNA, 32 bp, Homo sapiens
aagaaagccatctcttcctctgatctggggtc

SEQ ID NO: 18352 - DNA, 32 bp, Homo sapiens
tcttgttgcccagggctggagtgcagtggcat

SEQ ID NO: 18353 - DNA, 32 bp, Homo sapiens
ccactgtcgcccagactggagtccagtggcac

SEQ ID NO: 18354 - DNA, 32 bp, Homo sapiens
ttcctggttgcccttttggaatgtgatcctgt

SEQ ID NO: 18355 - DNA, 32 bp, Homo sapiens
gcaggatgcccagggctcggaagcagtaagga

SEQ ID NO: 18356 - DNA, 32 bp, Homo sapiens
tgaggagcgtccattcctctggagtctctcct

SEQ ID NO: 18357 - DNA, 32 bp, Homo sapiens
ctggcctcaagcgatcctcccacctcgacctc

SEQ ID NO: 18358 - DNA, 32 bp, Homo sapiens
aacctccacctcccgggtcaagcaattctcct

SEQ ID NO: 18359 - DNA, 28 bp, Homo sapiens
cagattccaagtgctgctacttcaagtg

SEQ ID NO: 18360 - DNA, 32 bp, Homo sapiens
ccgggttcaagcaattctctgcctcagcctcc

SEQ ID NO: 18361 - DNA, 32 bp, Homo sapiens
ccttccagcacctcctctcttctccttttgcc

SEQ ID NO: 18362 - DNA, 32 bp, Homo sapiens
ccattgcatttgtcacctagtcactgtatata

SEQ ID NO: 18363 - DNA, 24 bp, Homo sapiens
tcatgcctgtaatctcagctactt

SEQ ID NO: 18364 - DNA, 23 bp, Homo sapiens
tggcgtgaccttggctcactgca

SEQ ID NO: 18365 - DNA, 25 bp, Homo sapiens
acaggtgcacaccaccacacctggc

SEQ ID NO: 18366 - DNA, 32 bp, Homo sapiens
cgagggcctggcggagcttccagctgggacca

SEQ ID NO: 18367 - DNA, 32 bp, Homo sapiens
ggggccgcgctgcttagccactgggaccccac

SEQ ID NO: 18368 - DNA, 23 bp, Homo sapiens
tggcacgttctcagctcactgca

SEQ ID NO: 18369 - DNA, 23 bp, Homo sapiens
tggcgtgatcttggcttactgca

SEQ ID NO: 18370 - DNA, 32 bp, Homo sapiens
actctgttacccaggctggaatgcagtggcgc

SEQ ID NO: 18371 - DNA, 32 bp, Homo sapiens
tgccctgttgccaggctggaatgcagtggcgt

SEQ ID NO: 18372 - DNA, 32 bp, Homo sapiens
catgatgggacttattctgtagctaatctgat

SEQ ID NO: 18373 - DNA, 32 bp, Homo sapiens
tcaggctcaagcaatcctcccgcctcagcctc

SEQ ID NO: 18374 - DNA, 32 bp, Homo sapiens
cagccttcaagcattccattacgccccatctc

SEQ ID NO: 18375 - DNA, 32 bp, Homo sapiens
actcagttgcccaggctggattgcggtggcgc

SEQ ID NO: 18376 - DNA, 32 bp, Homo sapiens
acagaaagacagggagaaagagaaacagaaaa

SEQ ID NO: 18377 - DNA, 32 bp, Homo sapiens
aggccagggaggcagtggaggcaggagaggct

SEQ ID NO: 18378 - DNA, 32 bp, Homo sapiens
acgcgacccaaaaccaaatgacccaccaccac

SEQ ID NO: 18379 - DNA, 32 bp, Homo sapiens
ctggctctggggctacagcttctgcctcctca

SEQ ID NO: 18380 - DNA, 32 bp, Homo sapiens
gagggaggcagaggagacttgaaacagatgga

SEQ ID NO: 18381 - DNA, 32 bp, Homo sapiens
atgcagctcgtagaggagagaaaacaagagtg

SEQ ID NO: 18382 - DNA, 32 bp, Homo sapiens
gccgtggtgctgctggtgtttggagttgcagc

SEQ ID NO: 18383 - DNA, 32 bp, Homo sapiens
ggtccccagccctcgtcgcagccccggccgcc

SEQ ID NO: 18384 - DNA, 32 bp, Homo sapiens
gagatcttgtggagctgggatcatgtttgaac

SEQ ID NO: 18385 - DNA, 32 bp, Homo sapiens
gtgggaagatgccttacgtctgatcttgatgg

SEQ ID NO: 18386 - DNA, 30 bp, Homo sapiens
tgaggatgttcaggctggggctgctggttt

SEQ ID NO: 18387 - DNA, 32 bp, Homo sapiens
ttaattatattggcaatgaagcactttcaatg

SEQ ID NO: 18388 - DNA, 32 bp, Homo sapiens
agtctggagactgggagccttcacttcggcct

SEQ ID NO: 18389 - DNA, 24 bp, Homo sapiens
ttgttgtccaggctggagtgcaat

SEQ ID NO: 18390 - DNA, 28 bp, Homo sapiens
cattaaccctgtgctgccacatctggct

SEQ ID NO: 18391 - DNA, 32 bp, Homo sapiens
gagccccgggggctgaggttgctgtgagccga

SEQ ID NO: 18392 - DNA, 32 bp, Homo sapiens
ccctatgggaggcagagcggcaaggacagggc

SEQ ID NO: 18393 - DNA, 32 bp, Homo sapiens
tggctccaggaggacttcctgcgtccatggaa

SEQ ID NO: 18394 - DNA, 24 bp, Homo sapiens
tcacgtttgtaatcccagcacttt

SEQ ID NO: 18395 - DNA, 32 bp, Homo sapiens
agtgtttttagaggagagaggaggaggaggag

SEQ ID NO: 18396 - DNA, 32 bp, Homo sapiens
ggggctagaagagcgagaaaattcaagaaaat

SEQ ID NO: 18397 - DNA, 32 bp, Homo sapiens
ttctgtttttgagacacttttctgccttctat

SEQ ID NO: 18398 - DNA, 24 bp, Homo sapiens
tcacgcctataatcctatcacttt

SEQ ID NO: 18399 - DNA, 24 bp, Homo sapiens
tcacgcttgtaattccagcacttt

SEQ ID NO: 18400 - DNA, 32 bp, Homo sapiens
ttgcttcagcccttccctgagtgcagtccccc

SEQ ID NO: 18401 - DNA, 32 bp, Homo sapiens
ctagggtgcctgggagcagcagtctagggctg

SEQ ID NO: 18402 - DNA, 32 bp, Homo sapiens
caattgcagctttattcagaaatataaaagtg

SEQ ID NO: 18403 - DNA, 32 bp, Homo sapiens
cagccacgaagggatggatgtgcatctgccct

SEQ ID NO: 18404 - DNA, 32 bp, Homo sapiens
gctacccaagagaccatggactgtggactctt

SEQ ID NO: 18405 - DNA, 32 bp, Homo sapiens
aaggagaagcagcaggaatgatgctttgatac

SEQ ID NO: 18406 - DNA, 32 bp, Homo sapiens
cccctaagcctgcactctgggcgctcctgctg

SEQ ID NO: 18407 - DNA, 32 bp, Homo sapiens
tggggagccaaggcaggagaatcgctttaggc

SEQ ID NO: 18408 - DNA, 32 bp, Homo sapiens
ggcctcccaaagtgctgggattacatgcgtga

SEQ ID NO: 18409 - DNA, 32 bp, Homo sapiens
ttactactgctgccgtcaatggtgctactata

SEQ ID NO: 18410 - DNA, 32 bp, Homo sapiens
agagaaagagaaagagaaagacaatcaagcag

SEQ ID NO: 18411 - DNA, 16 bp, Homo sapiens
ccctcaccacccagga

SEQ ID NO: 18412 - DNA, 32 bp, Homo sapiens
gtgtggtggaggcagaggagtgaggcccacgg

SEQ ID NO: 18413 - DNA, 32 bp, Homo sapiens
cgccaggtttcctggagctcttggcttcagcc

SEQ ID NO: 18414 - DNA, 32 bp, Homo sapiens
ttctgtcacccaggctggagtgcaaaggtgca

SEQ ID NO: 18415 - DNA, 32 bp, Homo sapiens
tgaaaagagactggccgaagaactgtgaatag

SEQ ID NO: 18416 - DNA, 32 bp, Homo sapiens
ccaggttcaagcaattctcctgcatcagcctc

SEQ ID NO: 18417 - DNA, 32 bp, Homo sapiens
ccctgccgcctgggctgtcagcactttggcag

SEQ ID NO: 18418 - DNA, 32 bp, Homo sapiens
ctcgccattcattacccggcttggttaatgca

SEQ ID NO: 18419 - DNA, 32 bp, Homo sapiens
acctccgcctcccggattcaagcaattctccc

SEQ ID NO: 18420 - DNA, 32 bp, Homo sapiens
acttccgcctcccgggttcaagcgattctcct

SEQ ID NO: 18421 - DNA, 32 bp, Homo sapiens
gtatgggtgtgttggggaagtcactgtgtttc

SEQ ID NO: 18422 - DNA, 32 bp, Homo sapiens
aaaactcttcccttggagagtcactgttcacc

SEQ ID NO: 18423 - DNA, 32 bp, Homo sapiens
gaacgtgggaggcggaggttgcagcgagctga

SEQ ID NO: 18424 - DNA, 32 bp, Homo sapiens
cccattgaacaacagctgctcatttcccccag

SEQ ID NO: 18425 - DNA, 32 bp, Homo sapiens
gccttgtcacccaggctggagtccagtggcac

SEQ ID NO: 18426 - DNA, 32 bp, Homo sapiens
tcgccttccctctcttctgtcccggccaggat

SEQ ID NO: 18427 - DNA, 32 bp, Homo sapiens
tcgccggcaggacactgcctggaacgcctgga

SEQ ID NO: 18428 - DNA, 32 bp, Homo sapiens
acctccgccttccaggttcaagcgattctcct

SEQ ID NO: 18429 - DNA, 32 bp, Homo sapiens
tcaggcaactgatttcaaatgcctatgaaacc

SEQ ID NO: 18430 - DNA, 32 bp, Homo sapiens
ccaggtcatccctccccgggcctggggcgctc

SEQ ID NO: 18431 - DNA, 32 bp, Homo sapiens
aagtcagccctctctatttcatgtgccaactc

SEQ ID NO: 18432 - DNA, 21 bp, Homo sapiens
gtcgcctaggctggagtgcaa

SEQ ID NO: 18433 - DNA, 32 bp, Homo sapiens
cttctcccagttctacctccccagaagccttc

SEQ ID NO: 18434 - DNA, 32 bp, Homo sapiens
cagagatggagtttcaccatattgcccaggct

SEQ ID NO: 18435 - DNA, 32 bp, Homo sapiens
ccctacgttgcgctgctcatcacagcccgggg

SEQ ID NO: 18436 - DNA, 32 bp, Homo sapiens
ctaagatcggaagatgagtgagcttgaccagt

SEQ ID NO: 18437 - DNA, 32 bp, Homo sapiens
cccagctgcccaggacggggcaagatgtccaa

SEQ ID NO: 18438 - DNA, 32 bp, Homo sapiens
gggaaaagaagaggaggcttaggatggtcaag

SEQ ID NO: 18439 - DNA, 32 bp, Homo sapiens
tttgctcacagcaattctccttctacagagga

SEQ ID NO: 18440 - DNA, 32 bp, Homo sapiens
atggcttcaagggaaactcccaccctcaatat

SEQ ID NO: 18441 - DNA, 32 bp, Homo sapiens
tgtcagcctaccagctcggagtgcagttcctg

SEQ ID NO: 18442 - DNA, 32 bp, Homo sapiens
cccggccccagtgccctttcgcggccacaagc

SEQ ID NO: 18443 - DNA, 28 bp, Homo sapiens
gggagtgggtgacctgcctcatcactgc

SEQ ID NO: 18444 - DNA, 24 bp, Homo sapiens
tcatgcctgtaatcccagaacttt

SEQ ID NO: 18445 - DNA, 24 bp, Homo sapiens
tcatgcctgtcatcccagcacttt

SEQ ID NO: 18446 - DNA, 32 bp, Homo sapiens
gaaatcgaagaggcagaaagaaacaacaaaac

SEQ ID NO: 18447 - DNA, 32 bp, Homo sapiens
cttccactgtgctctctgtcagctccaggtca

SEQ ID NO: 18448 - DNA, 32 bp, Homo sapiens
ttgaaggtgtcttggcatcttctgcctttgct

SEQ ID NO: 18449 - DNA, 18 bp, Homo sapiens
gcccctgccctgcctggg

SEQ ID NO: 18450 - DNA, 32 bp, Homo sapiens
gaaataaaagcgttgcagctgtggaaggagat

SEQ ID NO: 18451 - DNA, 32 bp, Homo sapiens
aactgaccagttctgtccttggctggggaccc

SEQ ID NO: 18452 - DNA, 22 bp, Homo sapiens
cagtgttttctttttccagccc

SEQ ID NO: 18453 - DNA, 32 bp, Homo sapiens
gaacccgggaagcagaggttgcagtgacagag

SEQ ID NO: 18454 - DNA, 32 bp, Homo sapiens
gcagaaacatgttcattttcccatgaaggaac

SEQ ID NO: 18455 - DNA, 32 bp, Homo sapiens
aatttatggccgtatcaaatggtagctgaaaa

SEQ ID NO: 18456 - DNA, 32 bp, Homo sapiens
ggtattgagaagagagaaagaagatagtgaga

SEQ ID NO: 18457 - DNA, 32 bp, Homo sapiens
cctcccctgagagtgaggacctcatccgacca

SEQ ID NO: 18458 - DNA, 32 bp, Homo sapiens
ctactcgggaggctgaggcaggagaatgaagt

SEQ ID NO: 18459 - DNA, 32 bp, Homo sapiens
ttgccattgcccaggaggggcccagtcaccat

SEQ ID NO: 18460 - DNA, 18 bp, Homo sapiens
aggtaccgctgtgtgcat

SEQ ID NO: 18461 - DNA, 32 bp, Homo sapiens
ccccgacatcttctggccctctggccagcacg

SEQ ID NO: 18462 - DNA, 32 bp, Homo sapiens
gtcctcccaaagtgctgggattaatggcgtga

SEQ ID NO: 18463 - DNA, 32 bp, Homo sapiens
gctctgtcgcccaggctggagggcagtggcac

SEQ ID NO: 18464 - DNA, 32 bp, Homo sapiens
actctttcacccaggctggagtgcagtggcac

SEQ ID NO: 18465 - DNA, 32 bp, Homo sapiens
atgctcccagttccctcgtccctgcccaggtc

SEQ ID NO: 18466 - DNA, 32 bp, Homo sapiens
acctccgccccctgggttcaagcgattctcct

SEQ ID NO: 18467 - DNA, 28 bp, Homo sapiens
ttggacccataggtagcctcatccctgc

SEQ ID NO: 18468 - DNA, 32 bp, Homo sapiens
agcctcctgagtagcttggattacaggcacaa

SEQ ID NO: 18469 - DNA, 32 bp, Homo sapiens
aggctcctgagtagctaggattacaggcacat

SEQ ID NO: 18470 - DNA, 32 bp, Homo sapiens
gttggagtagatgaggaatgggctcgtgatta

SEQ ID NO: 18471 - DNA, 32 bp, Homo sapiens
cagagaccaagtgcccacttagccgtgaaaaa

SEQ ID NO: 18472 - DNA, 28 bp, Homo sapiens
aaaatgcagtattcgcaccactgtgagc

SEQ ID NO: 18473 - DNA, 32 bp, Homo sapiens
gccccttctggggtgaggagtaccaagtgcac

SEQ ID NO: 18474 - DNA, 32 bp, Homo sapiens
gtggtgggagagcagaggtggacgcggccgag

SEQ ID NO: 18475 - DNA, 32 bp, Homo sapiens
ttcacgtgcccaggcctgtgggtagtggggag

SEQ ID NO: 18476 - DNA, 32 bp, Homo sapiens
catttttgtcatttccattaccacagatgtaa

SEQ ID NO: 18477 - DNA, 32 bp, Homo sapiens
tcgactccagttctggctgcccgcgggcctct

SEQ ID NO: 18478 - DNA, 32 bp, Homo sapiens
agaacagcacctcagagctcttaaatgcttat

SEQ ID NO: 18479 - DNA, 32 bp, Homo sapiens
agcctcctgagtagctgggattaccagtgcac

SEQ ID NO: 18480 - DNA, 32 bp, Homo sapiens
ggcctgggaaggagggtgctgtggagggggct

SEQ ID NO: 18481 - DNA, 24 bp, Homo sapiens
tcatgcctgtaatcctagtacttt

SEQ ID NO: 18482 - DNA, 32 bp, Homo sapiens
agaggacgaagaggaggaggatgaggaggaca

SEQ ID NO: 18483 - DNA, 32 bp, Homo sapiens
cacttatgtggaatctgctcccatgacccaag

SEQ ID NO: 18484 - DNA, 32 bp, Homo sapiens
agaaagagtgttggagttatctctctactaat

SEQ ID NO: 18485 - DNA, 32 bp, Homo sapiens
cctgtatttccatgtcaaatgttttcaaataa

SEQ ID NO: 18486 - DNA, 32 bp, Homo sapiens
ttcagaagccctaaaacataccaccttggcta

SEQ ID NO: 18487 - DNA, 32 bp, Homo sapiens
tagaagtcagctttcacatctgatttctgtat

SEQ ID NO: 18488 - DNA, 32 bp, Homo sapiens
atcgcctcttgttcggatttttgctactaccg

SEQ ID NO: 18489 - DNA, 32 bp, Homo sapiens
ggagggtcagaagcagaaagaaatcaaagctc

SEQ ID NO: 18490 - DNA, 32 bp, Homo sapiens
ccgagttcaagcaattctcctgcctcagctct

SEQ ID NO: 18491 - DNA, 32 bp, Homo sapiens
ggtgtcaggcctgctgcccttgccttgtcctc

SEQ ID NO: 18492 - DNA, 32 bp, Homo sapiens
ctctgttgcccaggctggagtgcagtagcacg

SEQ ID NO: 18493 - DNA, 32 bp, Homo sapiens
acaggctcaagcaattctcctgcctcagcctc

SEQ ID NO: 18494 - DNA, 32 bp, Homo sapiens
gctgcccgggagggcttcctggacacgctggt

SEQ ID NO: 18495 - DNA, 32 bp, Homo sapiens
ttcaatgacgcacacttcctgtggcatccctg

SEQ ID NO: 18496 - DNA, 32 bp, Homo sapiens
gtctagaactcctgggttcaagtaatcctccc

SEQ ID NO: 18497 - DNA, 32 bp, Homo sapiens
gcgggaggaagaggaggaggaggaggaggctg

SEQ ID NO: 18498 - DNA, 32 bp, Homo sapiens
gccaagaagagctgaaatagaaaacagcctag

SEQ ID NO: 18499 - DNA, 32 bp, Homo sapiens
tgaggaagaagaggagctgaaggtaagaaact

SEQ ID NO: 18500 - DNA, 32 bp, Homo sapiens
ggaactgacccaggctggacttgcggggagga

SEQ ID NO: 18501 - DNA, 32 bp, Homo sapiens
tgctgtagaagaggggaggaaacaagccagtg

SEQ ID NO: 18502 - DNA, 32 bp, Homo sapiens
cgcactgctgcagcttccctgagcctttccag

SEQ ID NO: 18503 - DNA, 32 bp, Homo sapiens
atcctcccaagtagctgggattacagatgcct

SEQ ID NO: 18504 - DNA, 32 bp, Homo sapiens
tccacgtttgacattccatcagatttcgtcca

SEQ ID NO: 18505 - DNA, 32 bp, Homo sapiens
tcctgtcgcccaggctggagtgcaatggcacg

SEQ ID NO: 18506 - DNA, 32 bp, Homo sapiens
agaccttcctcacccgctcccacctcacaccc

SEQ ID NO: 18507 - DNA, 32 bp, Homo sapiens
aggttccatcacaaaggggcagtattaattag

SEQ ID NO: 18508 - DNA, 32 bp, Homo sapiens
agcctcttgagtagctgggattacaggaacgc

SEQ ID NO: 18509 - DNA, 32 bp, Homo sapiens
gggcactctgcaggttctgcctttgagtcctc

SEQ ID NO: 18510 - DNA, 32 bp, Homo sapiens
acctccagctcctgggttcaggtgattctcct

SEQ ID NO: 18511 - DNA, 32 bp, Homo sapiens
acaccggcataaatctatttttgctaccagat

SEQ ID NO: 18512 - DNA, 32 bp, Homo sapiens
ggaaggaggggaggagaaaggcaaaagcaaac

SEQ ID NO: 18513 - DNA, 18 bp, Homo sapiens
cagggaagcttggggctc

SEQ ID NO: 18514 - DNA, 32 bp, Homo sapiens
ctaccgcaggcgaaggttcccaccttactaca

SEQ ID NO: 18515 - DNA, 32 bp, Homo sapiens
ctaggctcaagccatcctcccacctcagcctc

SEQ ID NO: 18516 - DNA, 32 bp, Homo sapiens
tggtgttgcccaggcagagagggcagtgtgga

SEQ ID NO: 18517 - DNA, 32 bp, Homo sapiens
agattgtccatgtccagaaacaacagtgtctt

SEQ ID NO: 18518 - DNA, 32 bp, Homo sapiens
ttatgttcaagcaattctccttccttagcctc

SEQ ID NO: 18519 - DNA, 32 bp, Homo sapiens
tatttctctgcagcgttccttccctggcccgg

SEQ ID NO: 18520 - DNA, 32 bp, Homo sapiens
tggggctctgcagttcctgcatctctaagctt

SEQ ID NO: 18521 - DNA, 32 bp, Homo sapiens
acctccgcctcctgggttcaagtaattctcct

SEQ ID NO: 18522 - DNA, 32 bp, Homo sapiens
gacgcggtgctgctgccgccgcttcgggtttg

SEQ ID NO: 18523 - DNA, 32 bp, Homo sapiens
tatggagttcagggagcttcagggttggcaaa

SEQ ID NO: 18524 - DNA, 32 bp, Homo sapiens
atttttcccaaaacaaagcccatgccttgctc

SEQ ID NO: 18525 - DNA, 32 bp, Homo sapiens
gacagccatcagaattctcccacaccaagtgc

SEQ ID NO: 18526 - DNA, 32 bp, Homo sapiens
gttcaagagatccatcctcccacctcagtctc

SEQ ID NO: 18527 - DNA, 32 bp, Homo sapiens
ctgtcacccaggctgaagtgcagtgcaggacc

SEQ ID NO: 18528 - DNA, 32 bp, Homo sapiens
cacacacatcttcccttccaaagggctttttc

SEQ ID NO: 18529 - DNA, 18 bp, Homo sapiens
atccgccctctgttgctc

SEQ ID NO: 18530 - DNA, 32 bp, Homo sapiens
ttccagatggagtctcgctttgttgcccaggc

SEQ ID NO: 18531 - DNA, 32 bp, Homo sapiens
ccttccgctcctggctgccacagggtcctccg

SEQ ID NO: 18532 - DNA, 32 bp, Homo sapiens
tcctgagctctgattcctcttctgtctggctg

SEQ ID NO: 18533 - DNA, 32 bp, Homo sapiens
ccaggctcaagaaatcctcccacctcagcctc

SEQ ID NO: 18534 - DNA, 32 bp, Homo sapiens
gattatagagcacagaaagaattctcaaacta

SEQ ID NO: 18535 - DNA, 32 bp, Homo sapiens
actaaggttcttgagcttatctcccaaggtac

SEQ ID NO: 18536 - DNA, 32 bp, Homo sapiens
taactggctgctccctgctcccagggactgac

SEQ ID NO: 18537 - DNA, 24 bp, Homo sapiens
tcacacctgtaaacccagcacttt

SEQ ID NO: 18538 - DNA, 24 bp, Homo sapiens
tcactcctgtaatcccagcacttt

SEQ ID NO: 18539 - DNA, 32 bp, Homo sapiens
tgatgaaatttccagacagaaagagccctttt

SEQ ID NO: 18540 - DNA, 32 bp, Homo sapiens
ttgagacggagtttcgctcttgttgcccaagc

SEQ ID NO: 18541 - DNA, 24 bp, Homo sapiens
agagaggccttggcccagctgacc

SEQ ID NO: 18542 - DNA, 32 bp, Homo sapiens
aatcttttaagatactgacaccaaatgccttt

SEQ ID NO: 18543 - DNA, 32 bp, Homo sapiens
atacacctagttctgtatgatcatatcatagt

SEQ ID NO: 18544 - DNA, 32 bp, Homo sapiens
ttgagacggagtttcgctcttattgcccaggc

SEQ ID NO: 18545 - DNA, 32 bp, Homo sapiens
ttgagatggagttttgctcttattgcccaggc

SEQ ID NO: 18546 - DNA, 32 bp, Homo sapiens
ctctactacatgtgactggcagtattaagtgt

SEQ ID NO: 18547 - DNA, 32 bp, Homo sapiens
gccctgttgcccaggctgaagtgcagtggtgc

SEQ ID NO: 18548 - DNA, 32 bp, Homo sapiens
accctgttgcccaggctacagtgcaatggcat

SEQ ID NO: 18549 - DNA, 32 bp, Homo sapiens
ccaggctcaagcaattctcctgcctcagcctc

SEQ ID NO: 18550 - DNA, 28 bp, Homo sapiens
ctcccgaccagtgctgccctgtttgccc

SEQ ID NO: 18551 - DNA, 32 bp, Homo sapiens
ttggactcacccagatctagtgcagggacaca

SEQ ID NO: 18552 - DNA, 32 bp, Homo sapiens
ccaggttcaagcaattctcctgcctcagcttc

SEQ ID NO: 18553 - DNA, 32 bp, Homo sapiens
catcacttcccatgccccatctcgactcccat

SEQ ID NO: 18554 - DNA, 32 bp, Homo sapiens
atgtcggcggcgctggggttgcagggaaaaga

SEQ ID NO: 18555 - DNA, 32 bp, Homo sapiens
ttctggaacttctgggctcaagcaattttcct

SEQ ID NO: 18556 - DNA, 23 bp, Homo sapiens
gcccagggacccctgccttcccc

SEQ ID NO: 18557 - DNA, 32 bp, Homo sapiens
gcaggtgttgttctgaccccagctccactgtg

SEQ ID NO: 18558 - DNA, 20 bp, Homo sapiens
gccgtatttggcacccagaa

SEQ ID NO: 18559 - DNA, 32 bp, Homo sapiens
ggcagctggaggagctgggacggcggcatgag

SEQ ID NO: 18560 - DNA, 32 bp, Homo sapiens
atcgcagacagtcaggcttcaggctgtctgac

SEQ ID NO: 18561 - DNA, 32 bp, Homo sapiens
actctgtcgcccgggctggagtgctgtgagct

SEQ ID NO: 18562 - DNA, 32 bp, Homo sapiens
aaaaatgtacctgattgctcccaattatgaga

SEQ ID NO: 18563 - DNA, 32 bp, Homo sapiens
tggaactcccgatttcaggtgggctaaaagag

SEQ ID NO: 18564 - DNA, 16 bp, Homo sapiens
gcccctgccctgtggg

SEQ ID NO: 18565 - DNA, 32 bp, Homo sapiens
ccaaatgtccacgcccagaacaacagttggca

SEQ ID NO: 18566 - DNA, 32 bp, Homo sapiens
gacgccgggaggccacgggtgctgctgacggg

SEQ ID NO: 18567 - DNA, 32 bp, Homo sapiens
attggctctgcagccccctaacctgcctctgg

SEQ ID NO: 18568 - DNA, 32 bp, Homo sapiens
acagcctctgcaggccctgctcttgcctccca

SEQ ID NO: 18569 - DNA, 32 bp, Homo sapiens
ctggcccatcttctgcctcacagtggccactc

SEQ ID NO: 18570 - DNA, 22 bp, Homo sapiens
gaaagaaggaaataaaacatca

SEQ ID NO: 18571 - DNA, 20 bp, Homo sapiens
cccggcgccgcccgctcggc

SEQ ID NO: 18572 - DNA, 32 bp, Homo sapiens
ttttaccccaaaactcagacaggactttctat

SEQ ID NO: 18573 - DNA, 25 bp, Homo sapiens
acagttcagcagctaccaccctggc

SEQ ID NO: 18574 - DNA, 21 bp, Homo sapiens
gccatcacattgtcacccaga

SEQ ID NO: 18575 - DNA, 32 bp, Homo sapiens
ctctgttccctctcttcgcggagcggcgccgc

SEQ ID NO: 18576 - DNA, 32 bp, Homo sapiens
gcctgcgcctccatccatctgtccgtccagag

SEQ ID NO: 18577 - DNA, 32 bp, Homo sapiens
ggaggtaaagggaggttttcactgtgggtgtt

SEQ ID NO: 18578 - DNA, 32 bp, Homo sapiens
gcgcatgattacttgttttatatttcatgttg

SEQ ID NO: 18579 - DNA, 32 bp, Homo sapiens
ttgggctcaagcgatcctcccacctgggactc

SEQ ID NO: 18580 - DNA, 32 bp, Homo sapiens
ccaggttcatgcaattctcctgcctcagtctc

SEQ ID NO: 18581 - DNA, 32 bp, Homo sapiens
aaaccaggtatccacacatagcacttttattc

SEQ ID NO: 18582 - DNA, 32 bp, Homo sapiens
tcactccatgaatgactggagtgtaggggcag

SEQ ID NO: 18583 - DNA, 32 bp, Homo sapiens
ttaaagactgatattcaaatgctgtagtgttg

SEQ ID NO: 18584 - DNA, 32 bp, Homo sapiens
acctccgcctcccgggttcaagcagttctcct

SEQ ID NO: 18585 - DNA, 28 bp, Homo sapiens
ctcacctcaactgctgccttctgtccag

SEQ ID NO: 18586 - DNA, 28 bp, Homo sapiens
ttacctatgtgtgctgcctcattcctgg

SEQ ID NO: 18587 - DNA, 24 bp, Homo sapiens
tcatggccatttggcatgattgca

SEQ ID NO: 18588 - DNA, 32 bp, Homo sapiens
aatcaaggagaaggacaaagaaaacaagttcc

SEQ ID NO: 18589 - DNA, 32 bp, Homo sapiens
ccctcaacctcctgggttcaagcaatcctcct

SEQ ID NO: 18590 - DNA, 32 bp, Homo sapiens
tctgatgcagaacgtatcagtgaaactccctc

SEQ ID NO: 18591 - DNA, 32 bp, Homo sapiens
aaccctccctcctcttcttgctggaggacctg

SEQ ID NO: 18592 - DNA, 32 bp, Homo sapiens
ccagcagctgcagctcggcctctgctgcctgc

SEQ ID NO: 18593 - DNA, 32 bp, Homo sapiens
actttgtcgcccaggccggagtgcagtggtgc

SEQ ID NO: 18594 - DNA, 32 bp, Homo sapiens
cctttgtcacccaggccggagtgcagtggcat

SEQ ID NO: 18595 - DNA, 32 bp, Homo sapiens
agtggtgctttacttagccctgtggacaactt

SEQ ID NO: 18596 - DNA, 23 bp, Homo sapiens
ggaggaggaagaggaggcgatag

SEQ ID NO: 18597 - DNA, 32 bp, Homo sapiens
cacagctcatggagggtgagatcatgttaggg

SEQ ID NO: 18598 - DNA, 32 bp, Homo sapiens
gtctcccgggagcagaggttctatgaatccct

SEQ ID NO: 18599 - DNA, 32 bp, Homo sapiens
gcaggttctgcagcatcctgccttgctgctct

SEQ ID NO: 18600 - DNA, 32 bp, Homo sapiens
gtttcacctgcagctttcagtctgctttgtct

SEQ ID NO: 18601 - DNA, 20 bp, Homo sapiens
gcccccgttcccgtccaggt

SEQ ID NO: 18602 - DNA, 17 bp, Homo sapiens
ccatgcatgcacccaga

SEQ ID NO: 18603 - DNA, 20 bp, Homo sapiens
ggcacgcacacatgctctgc

SEQ ID NO: 18604 - DNA, 20 bp, Homo sapiens
ctggagaaccggcctgggtt

SEQ ID NO: 18605 - DNA, 32 bp, Homo sapiens
ggcccagtgccaggctgggcccaagtgtcgat

SEQ ID NO: 18606 - DNA, 32 bp, Homo sapiens
ccgcttcatccctctcaagtatggctcagcta

SEQ ID NO: 18607 - DNA, 32 bp, Homo sapiens
cgccttcttccctcgtggacaggagtcagcca

SEQ ID NO: 18608 - DNA, 32 bp, Homo sapiens
ctaggcccttcttgcactgccacctcactttc

SEQ ID NO: 18609 - DNA, 32 bp, Homo sapiens
actctgttacccaggctggagtgcaatggagt

SEQ ID NO: 18610 - DNA, 32 bp, Homo sapiens
ctctgtaactcaggctggagtgcagtggcgcg

SEQ ID NO: 18611 - DNA, 32 bp, Homo sapiens
ctgggctcaagggatcctgccacctcagctaa

SEQ ID NO: 18612 - DNA, 32 bp, Homo sapiens
cagaagtggatcacctgctggtggaaatgtgg

SEQ ID NO: 18613 - DNA, 32 bp, Homo sapiens
agctcggcctcctgggttcaaatgattctcct

SEQ ID NO: 18614 - DNA, 32 bp, Homo sapiens
tctttaagctgcctggattgcacctttgaaat

SEQ ID NO: 18615 - DNA, 20 bp, Homo sapiens
tcagaaggagcgtggcccag

SEQ ID NO: 18616 - DNA, 32 bp, Homo sapiens
agagtcagaagaggagaaggccacggtacaga

SEQ ID NO: 18617 - DNA, 32 bp, Homo sapiens
gagcccagcaggcagaggttgcagtgagctga

SEQ ID NO: 18618 - DNA, 32 bp, Homo sapiens
acccgtgcagattaaagtaactgtgaagtttt

SEQ ID NO: 18619 - DNA, 32 bp, Homo sapiens
tctgcaggagcaagtgagtactgtgaacacct

SEQ ID NO: 18620 - DNA, 32 bp, Homo sapiens
cctgccagccctttctggattactgatagaaa

SEQ ID NO: 18621 - DNA, 32 bp, Homo sapiens
ctgccaagaagcggaaaactacctaggtccaa

SEQ ID NO: 18622 - DNA, 32 bp, Homo sapiens
tcttggtgcccaggctagagtgcaatggcgcg

SEQ ID NO: 18623 - DNA, 32 bp, Homo sapiens
aggcttggaagaggatgataaagaaaatgata

SEQ ID NO: 18624 - DNA, 32 bp, Homo sapiens
gtacctgggaggaggaggttgcagtgagctga

SEQ ID NO: 18625 - DNA, 21 bp, Homo sapiens
tttcagtcatataatggtgtg

SEQ ID NO: 18626 - DNA, 32 bp, Homo sapiens
gatggtgcctgagacccctgccttagaaacag

SEQ ID NO: 18627 - DNA, 32 bp, Homo sapiens
gtttactctgcagcctgtgttttctgtttccc

SEQ ID NO: 18628 - DNA, 28 bp, Homo sapiens
ctctgttgcccaggctggagtgcagtgg

SEQ ID NO: 18629 - DNA, 32 bp, Homo sapiens
catgccctcaccccacttctttgctacctagc

SEQ ID NO: 18630 - DNA, 23 bp, Homo sapiens
gggaggcagccagcggggcgtga

SEQ ID NO: 18631 - DNA, 32 bp, Homo sapiens
ccgggttcaagcaattatttgcctcagcctcc

SEQ ID NO: 18632 - DNA, 32 bp, Homo sapiens
ccagggcgagagttgaaaaactacctacaggg

SEQ ID NO: 18633 - DNA, 32 bp, Homo sapiens
ttacaaaattgctggctgggtgcagtggctta

SEQ ID NO: 18634 - DNA, 28 bp, Homo sapiens
taccctaaaagtgctgtctcttcaagtc

SEQ ID NO: 18635 - DNA, 32 bp, Homo sapiens
gcctcgacctcctgggctcaagcaatcctcac

SEQ ID NO: 18636 - DNA, 28 bp, Homo sapiens
tgtacctgcagtgctgcttttcttgcct

SEQ ID NO: 18637 - DNA, 28 bp, Homo sapiens
caccacccaagtgtccagcctctctgtg

SEQ ID NO: 18638 - DNA, 32 bp, Homo sapiens
tttttgatgctgctgtgtacagtcttcattat

SEQ ID NO: 18639 - DNA, 32 bp, Homo sapiens
ccagggctggtgctgctcttccctcagctctg

SEQ ID NO: 18640 - DNA, 32 bp, Homo sapiens
gaaatagcctgaggtggctcaggaagcggaga

SEQ ID NO: 18641 - DNA, 32 bp, Homo sapiens
gccactgcactccagctggagtgacagagcca

SEQ ID NO: 18642 - DNA, 32 bp, Homo sapiens
gtctcttacccaggctagggtgcagtggtgtg

SEQ ID NO: 18643 - DNA, 19 bp, Homo sapiens
ggccgcggccggcgggcct

SEQ ID NO: 18644 - DNA, 32 bp, Homo sapiens
ccaggttcaagcaattcttctgcctcagcctc

SEQ ID NO: 18645 - DNA, 32 bp, Homo sapiens
gagacagagaaagagagagaattctttcaagt

SEQ ID NO: 18646 - DNA, 32 bp, Homo sapiens
tcccgcctcagtagctgggattacaggtgccc

SEQ ID NO: 18647 - DNA, 32 bp, Homo sapiens
ttttccatcctgtattctcccacatcactact

SEQ ID NO: 18648 - DNA, 32 bp, Homo sapiens
gagcctgggaagttgaggctgcagtgagccgt

SEQ ID NO: 18649 - DNA, 28 bp, Homo sapiens
tggttttctgatgttgcctcatttcctg

SEQ ID NO: 18650 - DNA, 32 bp, Homo sapiens
actgggaactgcaccagatgctcagacttggt

SEQ ID NO: 18651 - DNA, 31 bp, Homo sapiens
ggtttcaaacagtgggataggagggacactt

SEQ ID NO: 18652 - DNA, 21 bp, Homo sapiens
tcacgcctgtaatcccagcac

SEQ ID NO: 18653 - DNA, 32 bp, Homo sapiens
gaacctgggaggcagagtctgcagtgagccga

SEQ ID NO: 18654 - DNA, 32 bp, Homo sapiens
cccctgctctgggcttctctcctgttttcccc

SEQ ID NO: 18655 - DNA, 20 bp, Homo sapiens
tgtgggaaactgagagggga

SEQ ID NO: 18656 - DNA, 32 bp, Homo sapiens
tcgtgttgttactgtctcaagtggaagcgccc

SEQ ID NO: 18657 - DNA, 17 bp, Homo sapiens
cctcctgcaacccagaa

SEQ ID NO: 18658 - DNA, 32 bp, Homo sapiens
gacaaaactaaccttgaataaggcccactgta

SEQ ID NO: 18659 - DNA, 32 bp, Homo sapiens
aaatgtatttccaaataccaccaccttaaggg

SEQ ID NO: 18660 - DNA, 32 bp, Homo sapiens
tgtggaccagaactttgaccttgtgaatgcat

SEQ ID NO: 18661 - DNA, 32 bp, Homo sapiens
ttcagggcctaggaaggggagcattcaggaac

SEQ ID NO: 18662 - DNA, 32 bp, Homo sapiens
cggcttgtgctgctctgcgctctccgcttcgc

SEQ ID NO: 18663 - DNA, 32 bp, Homo sapiens
caagtggccaggaattctcctcctgcaccggg

SEQ ID NO: 18664 - DNA, 32 bp, Homo sapiens
tcactcttgcccaggctggagtgcagtggtgc

SEQ ID NO: 18665 - DNA, 32 bp, Homo sapiens
gctcctcacccaggctggaatgcagtggtgtg

SEQ ID NO: 18666 - DNA, 32 bp, Homo sapiens
caagattttgtcccattttcccatgaagctac

SEQ ID NO: 18667 - DNA, 21 bp, Homo sapiens
gatgaggacaagatctgtggg

SEQ ID NO: 18668 - DNA, 32 bp, Homo sapiens
ccagcagcaggaggagaaagaacatggcgggc

SEQ ID NO: 18669 - DNA, 32 bp, Homo sapiens
gtggtcactagtgcccttcccaaggcaagtca

SEQ ID NO: 18670 - DNA, 28 bp, Homo sapiens
tccatgctgctgctgactcggagcccca

SEQ ID NO: 18671 - DNA, 32 bp, Homo sapiens
gcctgacatcttctgccctggtcccctttctc

SEQ ID NO: 18672 - DNA, 18 bp, Homo sapiens
gcctgtgtcctccaggta

SEQ ID NO: 18673 - DNA, 32 bp, Homo sapiens
tagtagaagttaaggatgagaaaacaagcagt

SEQ ID NO: 18674 - DNA, 22 bp, Homo sapiens
acagctatgccaccaccctagc

SEQ ID NO: 18675 - DNA, 32 bp, Homo sapiens
gcctcccctgcccctgctccagctccatcccc

SEQ ID NO: 18676 - DNA, 32 bp, Homo sapiens
ggctgtttgcccaggaacttagggtgggtacc

SEQ ID NO: 18677 - DNA, 32 bp, Homo sapiens
gctctgttgcccaggctccagtgcagtggtgt

SEQ ID NO: 18678 - DNA, 32 bp, Homo sapiens
acggagcctcccaggctggggcagtgggcatg

SEQ ID NO: 18679 - DNA, 32 bp, Homo sapiens
ccaggttcaagcaattctgcctcagcctccca

SEQ ID NO: 18680 - DNA, 32 bp, Homo sapiens
ctggcctcaagcaatccactcatctcggcctc

SEQ ID NO: 18681 - DNA, 32 bp, Homo sapiens
ttgagactgagtagatgaattattgaatgtga

SEQ ID NO: 18682 - DNA, 32 bp, Homo sapiens
atgaggggaagctggggtttgcagtggtttga

SEQ ID NO: 18683 - DNA, 32 bp, Homo sapiens
gaacccgggaggcggaggttgtggtgagccaa

SEQ ID NO: 18684 - DNA, 32 bp, Homo sapiens
gaacccaggaggcggaggttgcggtgagctga

SEQ ID NO: 18685 - DNA, 32 bp, Homo sapiens
gaacctaggaggcggaggttgcagtgagccaa

SEQ ID NO: 18686 - DNA, 32 bp, Homo sapiens
gaacctgggaggtggaggttgcagtgagtcga

SEQ ID NO: 18687 - DNA, 32 bp, Homo sapiens
gaacccgggaggcggaggttgtagtgagccga

SEQ ID NO: 18688 - DNA, 32 bp, Homo sapiens
gaactcgggaggtggaggttgcagtgagctga

SEQ ID NO: 18689 - DNA, 32 bp, Homo sapiens
gaacctgggaggcgaaggttgcagtgagccaa

SEQ ID NO: 18690 - DNA, 32 bp, Homo sapiens
gaacccgggaggcggaggttgcagtgagctga

SEQ ID NO: 18691 - DNA, 32 bp, Homo sapiens
gaacctgggaggcggaggttgcagtgagccga

SEQ ID NO: 18692 - DNA, 32 bp, Homo sapiens
tctcattttgggttttctcttctcctgctttc

SEQ ID NO: 18693 - DNA, 32 bp, Homo sapiens
gacggtggtcttctccctgcttggcaccctgc

SEQ ID NO: 18694 - DNA, 22 bp, Homo sapiens
gcccccacctctgcctccaggt

SEQ ID NO: 18695 - DNA, 32 bp, Homo sapiens
gcagcatggccaggctggccagggcgtgggca

SEQ ID NO: 18696 - DNA, 23 bp, Homo sapiens
ctgtcaccagactggagtgcagt

SEQ ID NO: 18697 - DNA, 23 bp, Homo sapiens
ctgtcaccaggctggagtacagt

SEQ ID NO: 18698 - DNA, 32 bp, Homo sapiens
ctctgtcacccaggctagagtgcagtggagcg

SEQ ID NO: 18699 - DNA, 32 bp, Homo sapiens
gctctgccgcccaggctggagtgcagtggcgc

SEQ ID NO: 18700 - DNA, 32 bp, Homo sapiens
gctctgtcacccaggctggagtacactggcac

SEQ ID NO: 18701 - DNA, 32 bp, Homo sapiens
agattaaactctgattttgagcactttgtgct

SEQ ID NO: 18702 - DNA, 32 bp, Homo sapiens
aataacagcctgaggttccaattctttatcat

SEQ ID NO: 18703 - DNA, 32 bp, Homo sapiens
ctctgttacccaggctggagtgcaatggagtg

SEQ ID NO: 18704 - DNA, 32 bp, Homo sapiens
ctgggctcaagcaaccctcccacctcccatgc

SEQ ID NO: 18705 - DNA, 32 bp, Homo sapiens
ccacattcaaacctgttaattcgctgttatca

SEQ ID NO: 18706 - DNA, 32 bp, Homo sapiens
gtctcaaactcctcggttcaagcaattcgccc

SEQ ID NO: 18707 - DNA, 32 bp, Homo sapiens
aggctgggccaagcccttaagtcaggagcagt

SEQ ID NO: 18708 - DNA, 32 bp, Homo sapiens
ctcctcccttctctccccagttctggtcctgg

SEQ ID NO: 18709 - DNA, 32 bp, Homo sapiens
gaacccaggaggcagagtttgcagtgagctga

SEQ ID NO: 18710 - DNA, 32 bp, Homo sapiens
atcactgacagcagctccttctggacccagtc

SEQ ID NO: 18711 - DNA, 32 bp, Homo sapiens
gtgacaggaagaggagggagagggtgacgaac

SEQ ID NO: 18712 - DNA, 32 bp, Homo sapiens
tagagatggagttttgccatgtggtcccaggc

SEQ ID NO: 18713 - DNA, 24 bp, Homo sapiens
gtcacccaggctggagtgcagtag

SEQ ID NO: 18714 - DNA, 32 bp, Homo sapiens
ggatctcccatagcttctcctttgcttccagg

SEQ ID NO: 18715 - DNA, 32 bp, Homo sapiens
tccctctgcccaggtgggggccgtggctggaa

SEQ ID NO: 18716 - DNA, 32 bp, Homo sapiens
gctcagttgcccagactggagagcagtggcca

SEQ ID NO: 18717 - DNA, 32 bp, Homo sapiens
gggagggaggagggagaaagggataatgatgc

SEQ ID NO: 18718 - DNA, 32 bp, Homo sapiens
cctaacctaagctgcttcctggaaagcttcat

SEQ ID NO: 18719 - DNA, 32 bp, Homo sapiens
ttctgggttcaagtgattcttctgcctcagcc

SEQ ID NO: 18720 - DNA, 32 bp, Homo sapiens
cagattgtgagctcctggagggcaggagctgt

SEQ ID NO: 18721 - DNA, 32 bp, Homo sapiens
ggaggaggaagaggaaacaagatatgacaagg

SEQ ID NO: 18722 - DNA, 32 bp, Homo sapiens
tgggttctgcatgtgttcctggcagctgggcc

SEQ ID NO: 18723 - DNA, 32 bp, Homo sapiens
acagatgcagaacaagtcatatttgaagaatg

SEQ ID NO: 18724 - DNA, 32 bp, Homo sapiens
tgggtgcccggcctggaacacaggttctgtct

SEQ ID NO: 18725 - DNA, 32 bp, Homo sapiens
ctgggttcaagcaattctcctacctcagcttc

SEQ ID NO: 18726 - DNA, 32 bp, Homo sapiens
agcctgcccaggtgctgagattacatgtatga

SEQ ID NO: 18727 - DNA, 32 bp, Homo sapiens
gtcatgtgacgaggaagaggtgatctgaccca

SEQ ID NO: 18728 - DNA, 21 bp, Homo sapiens
tgtgggaaggggagataaggg

SEQ ID NO: 18729 - DNA, 32 bp, Homo sapiens
gtgtgcagacgtgcctgctccctggatgccag

SEQ ID NO: 18730 - DNA, 32 bp, Homo sapiens
atggacccaagtgccctggaggctctgatcaa

SEQ ID NO: 18731 - DNA, 32 bp, Homo sapiens
tcctgggctcaagcgatccttctgccttggcc

SEQ ID NO: 18732 - DNA, 32 bp, Homo sapiens
tcccaggctcaagcgatccttctgcctcagcc

SEQ ID NO: 18733 - DNA, 32 bp, Homo sapiens
tcagtctggtctgttacttttctgcctagagg

SEQ ID NO: 18734 - DNA, 32 bp, Homo sapiens
atgggtgaatgagcttgtcaatgtgattttaa

SEQ ID NO: 18735 - DNA, 32 bp, Homo sapiens
tctgtatgcccagggtgagaagccgagtggct

SEQ ID NO: 18736 - DNA, 32 bp, Homo sapiens
ggaccagagagaggagaaagcggagacaggta

SEQ ID NO: 18737 - DNA, 32 bp, Homo sapiens
gagactgaagattgttagggcaccttagaatg

SEQ ID NO: 18738 - DNA, 32 bp, Homo sapiens
gtcccctctgcaggctcattcctccttggtct

SEQ ID NO: 18739 - DNA, 32 bp, Homo sapiens
ggcaggcagaggagagcaagctacttctggga

SEQ ID NO: 18740 - DNA, 32 bp, Homo sapiens
gagcctgggaggttgtggttgcagtgagctat

SEQ ID NO: 18741 - DNA, 32 bp, Homo sapiens
tcccacatgccccgcatgcgtgcaatgcctcc

SEQ ID NO: 18742 - DNA, 32 bp, Homo sapiens
ttagtaatttaaatcagaaatattttataaaa

SEQ ID NO: 18743 - DNA, 32 bp, Homo sapiens
ttttccccatgaactctgaaccacctttgtct

SEQ ID NO: 18744 - DNA, 32 bp, Homo sapiens
tggctcatgcctgaatctcagcactttgggag

SEQ ID NO: 18745 - DNA, 32 bp, Homo sapiens
agcctcctgagtagctgggattgcaggcaccc

SEQ ID NO: 18746 - DNA, 32 bp, Homo sapiens
gctctgttgcccaggctagagtgcagtggtgc

SEQ ID NO: 18747 - DNA, 32 bp, Homo sapiens
accactgcctcccaggttcaagagattctcct

SEQ ID NO: 18748 - DNA, 32 bp, Homo sapiens
cttaattatagtctggcgtgatcatgtagaat

SEQ ID NO: 18749 - DNA, 32 bp, Homo sapiens
gaacccaggaggcagaggttgcagtgcaccaa

SEQ ID NO: 18750 - DNA, 32 bp, Homo sapiens
ctttgtctacaccattatgtgcgctgataagc

SEQ ID NO: 18751 - DNA, 32 bp, Homo sapiens
tccccacccccaggctggcagtagcactgctg

SEQ ID NO: 18752 - DNA, 32 bp, Homo sapiens
cttagggatggttcctggaagtggacacattt

SEQ ID NO: 18753 - DNA, 24 bp, Homo sapiens
tcactactctaattccagcacttt

SEQ ID NO: 18754 - DNA, 28 bp, Homo sapiens
cccgtgttgggtgctgccatctctacta

SEQ ID NO: 18755 - DNA, 32 bp, Homo sapiens
acacagccaagtgcatccgagcagcgcaggat

SEQ ID NO: 18756 - DNA, 32 bp, Homo sapiens
accctgtcacccaggctggaatgcaatggcac

SEQ ID NO: 18757 - DNA, 32 bp, Homo sapiens
catggcgttctctgtctcactgtaaactagtg

SEQ ID NO: 18758 - DNA, 18 bp, Homo sapiens
tgcatggacccggtgcaa

SEQ ID NO: 18759 - DNA, 32 bp, Homo sapiens
taattggaactggaagagggatcatgttttgt

SEQ ID NO: 18760 - DNA, 21 bp, Homo sapiens
gctgatcatagctcactgcag

SEQ ID NO: 18761 - DNA, 32 bp, Homo sapiens
gtccccgggtggctgcaggcagctccagcccg

SEQ ID NO: 18762 - DNA, 32 bp, Homo sapiens
agtgtaccttggagagctatccactcaggccc

SEQ ID NO: 18763 - DNA, 32 bp, Homo sapiens
acttatagaaaaggagaaaataattaaacagt

SEQ ID NO: 18764 - DNA, 32 bp, Homo sapiens
tttgagatggagtctcgctttgttgcccaggc

SEQ ID NO: 18765 - DNA, 32 bp, Homo sapiens
ggcctagagccaggagtactgcattcagttga

SEQ ID NO: 18766 - DNA, 32 bp, Homo sapiens
ctggtctcaagcaatctgcccgcctcggcctc

SEQ ID NO: 18767 - DNA, 32 bp, Homo sapiens
ctgtgttgccaaggctggagtgcaggccgcga

SEQ ID NO: 18768 - DNA, 32 bp, Homo sapiens
gcagcaagcccaggcggcggtggaaaggctaa

SEQ ID NO: 18769 - DNA, 32 bp, Homo sapiens
ataatggaagtgatgatgagaaaacaggactc

SEQ ID NO: 18770 - DNA, 32 bp, Homo sapiens
ttgaacctgggaggcagtttgcagtgagctga

SEQ ID NO: 18771 - DNA, 32 bp, Homo sapiens
tttttctctgcagatagttgcttctcttgctt

SEQ ID NO: 18772 - DNA, 32 bp, Homo sapiens
gccccctctgcaggctctctgtctgccctggg

SEQ ID NO: 18773 - DNA, 23 bp, Homo sapiens
tcagttgggggccacctgaccca

SEQ ID NO: 18774 - DNA, 32 bp, Homo sapiens
actgcctcagaagggagccactgtgaacctct

SEQ ID NO: 18775 - DNA, 32 bp, Homo sapiens
ttgagacagagtttcattcttgttgcccaggg

SEQ ID NO: 18776 - DNA, 32 bp, Homo sapiens
tcttcctgcagaggcctctttctgcctccatg

SEQ ID NO: 18777 - DNA, 32 bp, Homo sapiens
ctctgttatccaggctggtgtgcagtgataca

SEQ ID NO: 18778 - DNA, 32 bp, Homo sapiens
gtagtgccattttggccggacatggttggggt

SEQ ID NO: 18779 - DNA, 21 bp, Homo sapiens
ctgaccaacacgatgaaaccc

SEQ ID NO: 18780 - DNA, 32 bp, Homo sapiens
ccggtttcaagcaattctcctgcctcagcctc

SEQ ID NO: 18781 - DNA, 32 bp, Homo sapiens
actctgctgctcaggctggagtgcagtggtgc

SEQ ID NO: 18782 - DNA, 32 bp, Homo sapiens
ccaagcaggggagaggaatgaggggagcagct

SEQ ID NO: 18783 - DNA, 32 bp, Homo sapiens
acctccacctcctgggttcaagcagttctcgt

SEQ ID NO: 18784 - DNA, 32 bp, Homo sapiens
tcccctcccctcacttctcccacctgcagagc

SEQ ID NO: 18785 - DNA, 31 bp, Homo sapiens
taaaccaacaacacctaattggggaaagcat

SEQ ID NO: 18786 - DNA, 15 bp, Homo sapiens
gcccctgcccccagg

SEQ ID NO: 18787 - DNA, 32 bp, Homo sapiens
catagtggaagaggagagcatgaagcaaagaa

SEQ ID NO: 18788 - DNA, 32 bp, Homo sapiens
gggtactccaggtctctccaaactgctatata

SEQ ID NO: 18789 - DNA, 24 bp, Homo sapiens
ctgtcacacaggctggagtgcagt

SEQ ID NO: 18790 - DNA, 32 bp, Homo sapiens
tttgcttgaacagcttctcctgagtcctcctt

SEQ ID NO: 18791 - DNA, 32 bp, Homo sapiens
agggagtcgcccaggctggagagcggtggcgc

SEQ ID NO: 18792 - DNA, 32 bp, Homo sapiens
tcactggggttagaggtgggtccgaaataatc

SEQ ID NO: 18793 - DNA, 32 bp, Homo sapiens
aaggcagccgagagcatctccctggaggggcc

SEQ ID NO: 18794 - DNA, 32 bp, Homo sapiens
acttatctggtgcattctccccaccccacccc

SEQ ID NO: 18795 - DNA, 32 bp, Homo sapiens
gctcatacctgttaattccagcactttgggag

SEQ ID NO: 18796 - DNA, 32 bp, Homo sapiens
tttgaaagcaggtcatgttcactgcgatgctg

SEQ ID NO: 18797 - DNA, 32 bp, Homo sapiens
acctccgcctcttgggttcaagcaattctgct

SEQ ID NO: 18798 - DNA, 32 bp, Homo sapiens
atccttccatttgatcctcacaacagccatgt

SEQ ID NO: 18799 - DNA, 32 bp, Homo sapiens
gagactcatagaggagaagaagaggcaaaagg

SEQ ID NO: 18800 - DNA, 32 bp, Homo sapiens
aggagaggaagaggaggaagacagtgggagtc

SEQ ID NO: 18801 - DNA, 32 bp, Homo sapiens
gcctccgccttctgggttcaagcaattctcct

SEQ ID NO: 18802 - DNA, 32 bp, Homo sapiens
gattctgctaaagcttctctgtctttccctgt

SEQ ID NO: 18803 - DNA, 24 bp, Homo sapiens
tcacacctgtaattccagcacttt

SEQ ID NO: 18804 - DNA, 24 bp, Homo sapiens
tcacatctgtaatcccagcacttt

SEQ ID NO: 18805 - DNA, 32 bp, Homo sapiens
ctcttttgcccaggctggagcgaagtgacgag

SEQ ID NO: 18806 - DNA, 23 bp, Homo sapiens
gtcgcccaggctggagtgcattg

SEQ ID NO: 18807 - DNA, 32 bp, Homo sapiens
tagttttctgcagctctacctggcctgcttac

SEQ ID NO: 18808 - DNA, 32 bp, Homo sapiens
ctgggctcaggcgcttctcccaccttggcctc

SEQ ID NO: 18809 - DNA, 32 bp, Homo sapiens
agcctcctgagtagctgggactacagatgcat

SEQ ID NO: 18810 - DNA, 32 bp, Homo sapiens
agccagcatgcctggctgtgtgcagtggccag

SEQ ID NO: 18811 - DNA, 32 bp, Homo sapiens
gctccaagcagagcagaaagaaaacagatgat

SEQ ID NO: 18812 - DNA, 32 bp, Homo sapiens
tctctctgtgccctcctgcaatggcagccttg

SEQ ID NO: 18813 - DNA, 32 bp, Homo sapiens
tgttagccttttctccccagacttgttggcat

SEQ ID NO: 18814 - DNA, 21 bp, Homo sapiens
tcgtgggccgcgcatggccct

SEQ ID NO: 18815 - DNA, 32 bp, Homo sapiens
caccatcgtcttgctgattatatgtcaagttc

SEQ ID NO: 18816 - DNA, 32 bp, Homo sapiens
agcattgcagaacatgagtgctgatgagggca

SEQ ID NO: 18817 - DNA, 32 bp, Homo sapiens
agctagagccctcagtcacaggcaaaggctgg

SEQ ID NO: 18818 - DNA, 32 bp, Homo sapiens
gcttgttgcccaggctggaatgcaatggcgtg

SEQ ID NO: 18819 - DNA, 32 bp, Homo sapiens
agaattggaagaggaggcagaagaggagcagc

SEQ ID NO: 18820 - DNA, 32 bp, Homo sapiens
gaggccacagttctgtgagcagaggaagagct

SEQ ID NO: 18821 - DNA, 32 bp, Homo sapiens
ggcctcctgagtagctgggactgcagttgtaa

SEQ ID NO: 18822 - DNA, 32 bp, Homo sapiens
tcacgaggcttggacctgctgtggagggtgcc

SEQ ID NO: 18823 - DNA, 32 bp, Homo sapiens
gtgcctcttccactctggagtgaagttaatga

SEQ ID NO: 18824 - DNA, 32 bp, Homo sapiens
aggccattcagtgccctccacatggccttgcc

SEQ ID NO: 18825 - DNA, 32 bp, Homo sapiens
gagcccaggagtttgaggctgcagtgagttat

SEQ ID NO: 18826 - DNA, 32 bp, Homo sapiens
gaacctgggaggcggaggctgcagtgagccga

SEQ ID NO: 18827 - DNA, 32 bp, Homo sapiens
gacttagggaggcagagtggaggaagtgagag

SEQ ID NO: 18828 - DNA, 32 bp, Homo sapiens
cctaataagccttttggatgctaatctggatt

SEQ ID NO: 18829 - DNA, 32 bp, Homo sapiens
accccttggcccttcgctcttgctgccttaac

SEQ ID NO: 18830 - DNA, 32 bp, Homo sapiens
gacactcatcgaggagcttcactgtgcgggac

SEQ ID NO: 18831 - DNA, 24 bp, Homo sapiens
ctgtagcccaggccagagtgcagt

SEQ ID NO: 18832 - DNA, 32 bp, Homo sapiens
gctctgtggcccaggctggcgtgcagtgggcc

SEQ ID NO: 18833 - DNA, 32 bp, Homo sapiens
cttacccattacttggatatttgctacgatcc

SEQ ID NO: 18834 - DNA, 32 bp, Homo sapiens
cagcaaacctcctgggtttgaaaaattccaac

SEQ ID NO: 18835 - DNA, 32 bp, Homo sapiens
gaggaggtgagaggagaggaaggagaaaactg

SEQ ID NO: 18836 - DNA, 32 bp, Homo sapiens
ctggtggggaggcaggctggtggtggagtcat

SEQ ID NO: 18837 - DNA, 32 bp, Homo sapiens
gaagtagggaggaggaggttgcagtgagctga

SEQ ID NO: 18838 - DNA, 32 bp, Homo sapiens
gccagccaaggccagtggagtgctgtggggtc

SEQ ID NO: 18839 - DNA, 25 bp, Homo sapiens
cgtcacccaggctggagtgcaatgg

SEQ ID NO: 18840 - DNA, 21 bp, Homo sapiens
tcatgcctataatccaagcac

SEQ ID NO: 18841 - DNA, 32 bp, Homo sapiens
tggaaggccaaaggaataaaattcttttatat

SEQ ID NO: 18842 - DNA, 32 bp, Homo sapiens
gctacaggacatgggagctgctgcttgtggga

SEQ ID NO: 18843 - DNA, 32 bp, Homo sapiens
agaaaaatgtgtcttcagctggcagcatttat

SEQ ID NO: 18844 - DNA, 24 bp, Homo sapiens
tcacacctgtaaccctagcacttt

SEQ ID NO: 18845 - DNA, 32 bp, Homo sapiens
gaggcggctccagccccagacaacagcccagg

SEQ ID NO: 18846 - DNA, 32 bp, Homo sapiens
ttactcgggaggctgagacaggagaatcgctt

SEQ ID NO: 18847 - DNA, 23 bp, Homo sapiens
tggcgcgatctcggctcaccgca

SEQ ID NO: 18848 - DNA, 23 bp, Homo sapiens
tggcgcgatcttggctcactgca

SEQ ID NO: 18849 - DNA, 22 bp, Homo sapiens
atccacaatcccattactggga

SEQ ID NO: 18850 - DNA, 20 bp, Homo sapiens
cggggcaggaagggaggcgg

SEQ ID NO: 18851 - DNA, 23 bp, Homo sapiens
tggtgcgacctcggcttactgca

SEQ ID NO: 18852 - DNA, 23 bp, Homo sapiens
tggtgcgatctcggctcactgca

SEQ ID NO: 18853 - DNA, 32 bp, Homo sapiens
tgcccagtggtgcttcaactggtatctatgag

SEQ ID NO: 18854 - DNA, 32 bp, Homo sapiens
actttgtcgcccaggctggagtgcagtggcac

SEQ ID NO: 18855 - DNA, 32 bp, Homo sapiens
ccctctccagtaggcatccactgtggaagtgc

SEQ ID NO: 18856 - DNA, 32 bp, Homo sapiens
gctgcacgtcaggtgtcctccacctcagtact

SEQ ID NO: 18857 - DNA, 32 bp, Homo sapiens
gaccagcatgttctccccaaagaccagaatat

SEQ ID NO: 18858 - DNA, 32 bp, Homo sapiens
cacattttctacccaatcatctggatttcaag

SEQ ID NO: 18859 - DNA, 32 bp, Homo sapiens
gaacccaggaggtggaggttgcagtgagccag

SEQ ID NO: 18860 - DNA, 29 bp, Homo sapiens
tgagatggagttttcgctcttgttgccca

SEQ ID NO: 18861 - DNA, 32 bp, Homo sapiens
gctgccgtccccgcgtgtgaggcacagaaggg

SEQ ID NO: 18862 - DNA, 32 bp, Homo sapiens
ggtatacatcttcccctaatgcctatctgacc

SEQ ID NO: 18863 - DNA, 32 bp, Homo sapiens
tcttgttgcccaggctggagtacaatggcatg

SEQ ID NO: 18864 - DNA, 32 bp, Homo sapiens
tcttgtcacccagactggagtgcgatggcacg

SEQ ID NO: 18865 - DNA, 32 bp, Homo sapiens
cccaatagcccaggctggagtgcagtggcaga

SEQ ID NO: 18866 - DNA, 32 bp, Homo sapiens
tattttctagacaattctctattttactgaag

SEQ ID NO: 18867 - DNA, 32 bp, Homo sapiens
tccaaaagattaaaaggagttgttcttttctc

SEQ ID NO: 18868 - DNA, 32 bp, Homo sapiens
tcttgttgcccaggctggagtgcaatggcgtg

SEQ ID NO: 18869 - DNA, 32 bp, Homo sapiens
ggagcaacctaggtgtccaacaacagatgaat

SEQ ID NO: 18870 - DNA, 32 bp, Homo sapiens
tacaagcatcttctctggcgtggatccgctgc

SEQ ID NO: 18871 - DNA, 22 bp, Homo sapiens
gatgggggacaagctgtgtgga

SEQ ID NO: 18872 - DNA, 32 bp, Homo sapiens
tctgtcacccaaggcggagtgcagtgacgaca

SEQ ID NO: 18873 - DNA, 32 bp, Homo sapiens
ccaaggcagctttccttaccctgacacagccc

SEQ ID NO: 18874 - DNA, 32 bp, Homo sapiens
ccagctcatctttgattcagtgaccaacatac

SEQ ID NO: 18875 - DNA, 32 bp, Homo sapiens
cacagctctgcagcctgggctctgccctgcct

SEQ ID NO: 18876 - DNA, 32 bp, Homo sapiens
ttcagagtttgagataccttgttttcattttt

SEQ ID NO: 18877 - DNA, 32 bp, Homo sapiens
atccatcatccctcacagagatgtagaggatg

SEQ ID NO: 18878 - DNA, 32 bp, Homo sapiens
ctttatttttatttttgagacagggtcttgtg

SEQ ID NO: 18879 - DNA, 32 bp, Homo sapiens
ctttgtcacccaggctggagtgcaatggcaca

SEQ ID NO: 18880 - DNA, 32 bp, Homo sapiens
tggttttggtcatacttgctttgctacctaaa

SEQ ID NO: 18881 - DNA, 32 bp, Homo sapiens
tgtttaaatcagctgtttcatgtattagcctt

SEQ ID NO: 18882 - DNA, 32 bp, Homo sapiens
ctctgttgcctagactggagtgcaatggcgtg

SEQ ID NO: 18883 - DNA, 32 bp, Homo sapiens
cagggttgcccagggtggagtgcagtggcagg

SEQ ID NO: 18884 - DNA, 32 bp, Homo sapiens
gctgtgtcacctaggctggagtgcagtggcac

SEQ ID NO: 18885 - DNA, 32 bp, Homo sapiens
gtactcgggaggctgaggcaggagaatggcgt

SEQ ID NO: 18886 - DNA, 32 bp, Homo sapiens
tgagaagggcggcagaggcagtggggctggct

SEQ ID NO: 18887 - DNA, 32 bp, Homo sapiens
gagccgcagcggcgcctctcccagaagtatta

SEQ ID NO: 18888 - DNA, 32 bp, Homo sapiens
cttttacctgcagcttttcctgcttgatatag

SEQ ID NO: 18889 - DNA, 32 bp, Homo sapiens
ttcaggtgtccgttattcaggtgcaaagaaga

SEQ ID NO: 18890 - DNA, 32 bp, Homo sapiens
gtagggattgggttttgccttgttgcccaggc

SEQ ID NO: 18891 - DNA, 32 bp, Homo sapiens
tgtcatttcctgctgcttccagctccatccct

SEQ ID NO: 18892 - DNA, 32 bp, Homo sapiens
gcaggagccctctcatggtgaacagcaactat

SEQ ID NO: 18893 - DNA, 32 bp, Homo sapiens
tggatctgcccaggcggcggcggcggcggcgg

SEQ ID NO: 18894 - DNA, 32 bp, Homo sapiens
tagaaactacgtctgtcatactgggagcttta

SEQ ID NO: 18895 - DNA, 32 bp, Homo sapiens
gtaattatgagaggctgtcatatatcaaagca

SEQ ID NO: 18896 - DNA, 32 bp, Homo sapiens
actctgttgcccaggctgaagtgcagtggtgt

SEQ ID NO: 18897 - DNA, 32 bp, Homo sapiens
ctctgttgtccaggctggagtgcagtggcacg

SEQ ID NO: 18898 - DNA, 32 bp, Homo sapiens
acttgtcacccaggctggagtgcagtggctca

SEQ ID NO: 18899 - DNA, 32 bp, Homo sapiens
ctataaaagaattgcacgtatgagaaacctat

SEQ ID NO: 18900 - DNA, 32 bp, Homo sapiens
agtttgaaagagagggttccctatgaataaga

SEQ ID NO: 18901 - DNA, 32 bp, Homo sapiens
actttgacacccaggctggagtgcagtggtgc

SEQ ID NO: 18902 - DNA, 32 bp, Homo sapiens
ctgggctcaagcaatcctcccacctcagccta

SEQ ID NO: 18903 - DNA, 32 bp, Homo sapiens
ggctcatgcctgtaaacccagcactttgggag

SEQ ID NO: 18904 - DNA, 32 bp, Homo sapiens
agcctcctgagtagctgggactataggttgct

SEQ ID NO: 18905 - DNA, 32 bp, Homo sapiens
ttacctgggaggcagagggtgttatgggagga

SEQ ID NO: 18906 - DNA, 28 bp, Homo sapiens
ttttccccaagtgcttagttgccatcta

SEQ ID NO: 18907 - DNA, 32 bp, Homo sapiens
tgccttgctttctcttcttactgtcccacagc

SEQ ID NO: 18908 - DNA, 21 bp, Homo sapiens
tcagaaggggccacggcctcc

SEQ ID NO: 18909 - DNA, 32 bp, Homo sapiens
ggaagaggaagaggaaagcaaaggagtcaggg

SEQ ID NO: 18910 - DNA, 32 bp, Homo sapiens
agctgtctgagtttttaaatagctaatacgac

SEQ ID NO: 18911 - DNA, 23 bp, Homo sapiens
cagggaagtggagcctccagccc

SEQ ID NO: 18912 - DNA, 32 bp, Homo sapiens
gcatgagagacagcagggttgtcacaatattg

SEQ ID NO: 18913 - DNA, 32 bp, Homo sapiens
ctctgttgcccaggctggagtgcagtcgcaca

SEQ ID NO: 18914 - DNA, 32 bp, Homo sapiens
agatttgcccataggttaaacatggttagaaa

SEQ ID NO: 18915 - DNA, 32 bp, Homo sapiens
tcaggcccagttctcgtgcccttagaggggaa

SEQ ID NO: 18916 - DNA, 32 bp, Homo sapiens
agtttgtcacccaggctggagtgcagtggcat

SEQ ID NO: 18917 - DNA, 32 bp, Homo sapiens
tctctgtcacccaggctggagtgcaatggcgc

SEQ ID NO: 18918 - DNA, 32 bp, Homo sapiens
ctttgttgcccagaggatgtgcagttgtcatc

SEQ ID NO: 18919 - DNA, 32 bp, Homo sapiens
ccgggagcccacggcggttaattctttttacc

SEQ ID NO: 18920 - DNA, 32 bp, Homo sapiens
agcctgccaagtagctgggattacaggcatgc

SEQ ID NO: 18921 - DNA, 32 bp, Homo sapiens
ggtttgctttccatatctgatctttaatccac

SEQ ID NO: 18922 - DNA, 32 bp, Homo sapiens
gccctgaactcctggcctcaagcaatcctccc

SEQ ID NO: 18923 - DNA, 22 bp, Homo sapiens
gcacacctcccccagaggctgc

SEQ ID NO: 18924 - DNA, 32 bp, Homo sapiens
gcgtcttctcttctccaggcctatggtcctgc

SEQ ID NO: 18925 - DNA, 32 bp, Homo sapiens
ggttctggcaccacctgagcccactgggcatc

SEQ ID NO: 18926 - DNA, 23 bp, Homo sapiens
tggcgtgatctctgctcactgca

SEQ ID NO: 18927 - DNA, 32 bp, Homo sapiens
cccaaagtgtctgctttcaagcaccacaccca

SEQ ID NO: 18928 - DNA, 32 bp, Homo sapiens
cgctgcagctgccggactcttctgcttgtcac

SEQ ID NO: 18929 - DNA, 32 bp, Homo sapiens
tgttttgttctagccacactggcagctgttag

SEQ ID NO: 18930 - DNA, 32 bp, Homo sapiens
tcttgttgtccaggctggagtgcaatggcacg

SEQ ID NO: 18931 - DNA, 23 bp, Homo sapiens
tggcttgatctcggctcactgca

SEQ ID NO: 18932 - DNA, 32 bp, Homo sapiens
cccaactgtaccacgggcatgaggagctgaag

SEQ ID NO: 18933 - DNA, 28 bp, Homo sapiens
taatccacaagtgcttctcatattgccc

SEQ ID NO: 18934 - DNA, 28 bp, Homo sapiens
tgggcccacactgctgccttctcccagg

SEQ ID NO: 18935 - DNA, 32 bp, Homo sapiens
gccctgcctcttctccctctattgggactggt

SEQ ID NO: 18936 - DNA, 32 bp, Homo sapiens
tctcccaccatgcatgcaggtcactgtgtgtg

SEQ ID NO: 18937 - DNA, 32 bp, Homo sapiens
gccatgaatggtgcccttattaacaacagtgt

SEQ ID NO: 18938 - DNA, 32 bp, Homo sapiens
ctctgtcgtccaggctggagtgccgtggcgta

SEQ ID NO: 18939 - DNA, 32 bp, Homo sapiens
cccagatgcccaggctcacttcagtgttgagt

SEQ ID NO: 18940 - DNA, 23 bp, Homo sapiens
tggcgcaattttggctcactgca

SEQ ID NO: 18941 - DNA, 32 bp, Homo sapiens
actctattgctcaggctggagtgtggtggcag

SEQ ID NO: 18942 - DNA, 32 bp, Homo sapiens
ctctgtcgcccatgctggagtgcagtggcgcg

SEQ ID NO: 18943 - DNA, 32 bp, Homo sapiens
ctctctcgcccaggctggagtgcagtggtgcg

SEQ ID NO: 18944 - DNA, 32 bp, Homo sapiens
tcttgttgcccaggctagagtgcaatggcgcc

SEQ ID NO: 18945 - DNA, 32 bp, Homo sapiens
ctctgtcacccgggctggagtgcagtggcgcc

SEQ ID NO: 18946 - DNA, 32 bp, Homo sapiens
cgctctgtcaccaggcttgagtgcagtggtgt

SEQ ID NO: 18947 - DNA, 32 bp, Homo sapiens
gaacttgggaggtggaggttgcagtgagccag

SEQ ID NO: 18948 - DNA, 32 bp, Homo sapiens
gcgccttcaaacccagacatgctgctgctgct

SEQ ID NO: 18949 - DNA, 32 bp, Homo sapiens
aaaagagaaagaggagaagaagaatgatgagc

SEQ ID NO: 18950 - DNA, 32 bp, Homo sapiens
ctgaccaggagttcgaggctgcagtgagccga

SEQ ID NO: 18951 - DNA, 32 bp, Homo sapiens
gaacctgagaggcggaggttgcagtgagccaa

SEQ ID NO: 18952 - DNA, 32 bp, Homo sapiens
gtaaaagcccccgagacctcccagaagccaag

SEQ ID NO: 18953 - DNA, 32 bp, Homo sapiens
ccttaagaggcatccaagtagcattcatagtg

SEQ ID NO: 18954 - DNA, 32 bp, Homo sapiens
agacttggaagaggaggaggaggaggagaagg

SEQ ID NO: 18955 - DNA, 32 bp, Homo sapiens
aaaggttaagatgattctccctcctgcagcct

SEQ ID NO: 18956 - DNA, 32 bp, Homo sapiens
gcttcatgcctgtaatccaagcactttgagag

SEQ ID NO: 18957 - DNA, 32 bp, Homo sapiens
ggagattcaggcagactggtggcagtggagta

SEQ ID NO: 18958 - DNA, 32 bp, Homo sapiens
aacttttaagacaacagtgtggaacacaatca

SEQ ID NO: 18959 - DNA, 28 bp, Homo sapiens
gccccaggtgatgctgcctttgctgtcc

SEQ ID NO: 18960 - DNA, 28 bp, Homo sapiens
cccttatcaccagctgcctcttctgtgg

SEQ ID NO: 18961 - DNA, 24 bp, Homo sapiens
tcatgcctgaaatccctgcacttt

SEQ ID NO: 18962 - DNA, 32 bp, Homo sapiens
gaacccaggagtcagaggtttcagtgagccga

SEQ ID NO: 18963 - DNA, 32 bp, Homo sapiens
gcaggttaagacgacagcctgcgcccccaact

SEQ ID NO: 18964 - DNA, 32 bp, Homo sapiens
cctgtccatcttctccccaccaccgccccggt

SEQ ID NO: 18965 - DNA, 32 bp, Homo sapiens
gctcctgcacttctccccagagcgggaccctc

SEQ ID NO: 18966 - DNA, 23 bp, Homo sapiens
tcacacctgtaatcccagctact

SEQ ID NO: 18967 - DNA, 32 bp, Homo sapiens
tgtgccttcttgctgctcttagatttatttca

SEQ ID NO: 18968 - DNA, 23 bp, Homo sapiens
gtcacccaggccggagtgcagtg

SEQ ID NO: 18969 - DNA, 18 bp, Homo sapiens
cacagctcctccatgcct

SEQ ID NO: 18970 - DNA, 32 bp, Homo sapiens
gctctgttgcccaggcagtagtgcagtggcgc

SEQ ID NO: 18971 - DNA, 32 bp, Homo sapiens
ctctattgcccaggctggagtgcagtggtgta

SEQ ID NO: 18972 - DNA, 32 bp, Homo sapiens
aacttcccagttctgacattcacagcatgacc

SEQ ID NO: 18973 - DNA, 32 bp, Homo sapiens
agcctcctgagtagctgggactacaggcatgc

SEQ ID NO: 18974 - DNA, 32 bp, Homo sapiens
agcctcctgagtagctgggactataggcatgt

SEQ ID NO: 18975 - DNA, 32 bp, Homo sapiens
gcggcccaggcggggtgcgagtggcgcagtcg

SEQ ID NO: 18976 - DNA, 32 bp, Homo sapiens
gggaggaggaggaggaggttgcagtgagccga

SEQ ID NO: 18977 - DNA, 32 bp, Homo sapiens
cttgtgtggctgctgctgggtccagtcctgga

SEQ ID NO: 18978 - DNA, 32 bp, Homo sapiens
aaatctctgagaaccttcaagagcccaaaaac

SEQ ID NO: 18979 - DNA, 24 bp, Homo sapiens
tcatacgtgtaatcccagtacttt

SEQ ID NO: 18980 - DNA, 32 bp, Homo sapiens
gggaagaggcctgggatgctgctaaacatcct

SEQ ID NO: 18981 - DNA, 32 bp, Homo sapiens
ctgttgagtcgagaggaatgagattggggtca

SEQ ID NO: 18982 - DNA, 32 bp, Homo sapiens
ctttgtctcacatgattccagtgcagtagtgc

SEQ ID NO: 18983 - DNA, 32 bp, Homo sapiens
gagccgagggggtgggggttgcagtgagccaa

SEQ ID NO: 18984 - DNA, 28 bp, Homo sapiens
gggtatcttggtgctgcctgtattggtc

SEQ ID NO: 18985 - DNA, 32 bp, Homo sapiens
gcttttgcgtcaggcttctgcctgagctcggt

SEQ ID NO: 18986 - DNA, 32 bp, Homo sapiens
agcttccacctgctccccatctgcccacccac

SEQ ID NO: 18987 - DNA, 32 bp, Homo sapiens
gatggagggaggcagagtaacagcgaagaggg

SEQ ID NO: 18988 - DNA, 32 bp, Homo sapiens
aatattccagttctgggtcatttagagagata

SEQ ID NO: 18989 - DNA, 32 bp, Homo sapiens
cctttgcccattctgtcaggctggacgggagg

SEQ ID NO: 18990 - DNA, 32 bp, Homo sapiens
ggaccgtgtttccctgcaccagctccacgctg

SEQ ID NO: 18991 - DNA, 32 bp, Homo sapiens
ctgtgtcgccaaggctggagtgcagtggtgcg

SEQ ID NO: 18992 - DNA, 32 bp, Homo sapiens
ggtctgtcgccaggctggagtgcagtggcgcg

SEQ ID NO: 18993 - DNA, 32 bp, Homo sapiens
ctctgtctcccgggctggagtgcagtggcgcg

SEQ ID NO: 18994 - DNA, 32 bp, Homo sapiens
tggctcgtacctgtaatccagcactttgggaa

SEQ ID NO: 18995 - DNA, 32 bp, Homo sapiens
gctctgtcgctcaggctggagagcggtggtgc

SEQ ID NO: 18996 - DNA, 32 bp, Homo sapiens
ccccttgaggttcccttgtgagcttgaatcaa

SEQ ID NO: 18997 - DNA, 32 bp, Homo sapiens
gtgtgcaagtacgacttcgtggaggtgcgcag

SEQ ID NO: 18998 - DNA, 32 bp, Homo sapiens
ctgcagtgcaggtggctcctggaagaccctca

SEQ ID NO: 18999 - DNA, 32 bp, Homo sapiens
cttgctgcaaggctcttcctgggaactaaggg

SEQ ID NO: 19000 - DNA, 32 bp, Homo sapiens
gtgtctgtgtccctgattacttgagattaggg

SEQ ID NO: 19001 - DNA, 32 bp, Homo sapiens
gctcacttccagtagcagaaccaccttagttg

SEQ ID NO: 19002 - DNA, 32 bp, Homo sapiens
gaggatgaccagctagactcccatggaattgg

SEQ ID NO: 19003 - DNA, 32 bp, Homo sapiens
gacttggtggggagagaaagaatacagtgagt

SEQ ID NO: 19004 - DNA, 23 bp, Homo sapiens
tggcgtgatctcggctcaatgca

SEQ ID NO: 19005 - DNA, 32 bp, Homo sapiens
aatcatcacaggtcgatccaggcacagatctg

SEQ ID NO: 19006 - DNA, 32 bp, Homo sapiens
ctcctgtcacccattttgaagagtggcagaac

SEQ ID NO: 19007 - DNA, 32 bp, Homo sapiens
ctctcttgtccaggctggagtgcaatagcgcg

SEQ ID NO: 19008 - DNA, 32 bp, Homo sapiens
acaagtgcagaaggtgcaggtgcagtgggtac

SEQ ID NO: 19009 - DNA, 32 bp, Homo sapiens
gtgtttaagaattggttttgggagggcgagga

SEQ ID NO: 19010 - DNA, 32 bp, Homo sapiens
gtgaaatgtatctttcaactgtttagttaccc

SEQ ID NO: 19011 - DNA, 32 bp, Homo sapiens
tacagaaaagagacatttcagctgtgattatg

SEQ ID NO: 19012 - DNA, 32 bp, Homo sapiens
ctcaacatctgattgttttccacctcagcctg

SEQ ID NO: 19013 - DNA, 32 bp, Homo sapiens
aatgaggggcctgggagggaggagcttggtgc

SEQ ID NO: 19014 - DNA, 23 bp, Homo sapiens
ctgtcgccaagttggagtgcaat

SEQ ID NO: 19015 - DNA, 32 bp, Homo sapiens
gttcctccaagtgcacatttagccttaaaatc

SEQ ID NO: 19016 - DNA, 32 bp, Homo sapiens
cccacattctagaattctcccaacattatttt

SEQ ID NO: 19017 - DNA, 32 bp, Homo sapiens
tcagtcatcattaaacttctctggaccaaaaa

SEQ ID NO: 19018 - DNA, 32 bp, Homo sapiens
gaatccaggaggtggaggttgcagcgagccaa

SEQ ID NO: 19019 - DNA, 32 bp, Homo sapiens
acctccacctcccaggttcaagcaattctctt

SEQ ID NO: 19020 - DNA, 32 bp, Homo sapiens
cacccaaaggcaacatgacggaaccttgccaa

SEQ ID NO: 19021 - DNA, 32 bp, Homo sapiens
ctttgtctcctcttccccatctatgtcccttt

SEQ ID NO: 19022 - DNA, 32 bp, Homo sapiens
tgggaacatcttcaatgacatctgcaaccatt

SEQ ID NO: 19023 - DNA, 32 bp, Homo sapiens
cctttcaggatggaggaatgtgggcagtttga

SEQ ID NO: 19024 - DNA, 32 bp, Homo sapiens
agggtcacccaaatagctgagtgcagtccttg

SEQ ID NO: 19025 - DNA, 32 bp, Homo sapiens
acgcggagaagaggagaggacctacaagaacg

SEQ ID NO: 19026 - DNA, 32 bp, Homo sapiens
ttcactgtctccattccataaatctcttcctg

SEQ ID NO: 19027 - DNA, 32 bp, Homo sapiens
actccatcacccaggctggagtccagtggtgt

SEQ ID NO: 19028 - DNA, 32 bp, Homo sapiens
gctctgttgcccgggctggagtacaatggcat

SEQ ID NO: 19029 - DNA, 32 bp, Homo sapiens
gaacccaggaggcagaggttgcagtcagccaa

SEQ ID NO: 19030 - DNA, 32 bp, Homo sapiens
tttgtggccagatttcaaatagggagttaagt

SEQ ID NO: 19031 - DNA, 32 bp, Homo sapiens
gaacccgggaggcagagcttgcagtgagccga

SEQ ID NO: 19032 - DNA, 32 bp, Homo sapiens
gaacctcggaggctgaagttgcagtgagccaa

SEQ ID NO: 19033 - DNA, 32 bp, Homo sapiens
gaacccaggaggcagagcttgcagtgagccaa

SEQ ID NO: 19034 - DNA, 32 bp, Homo sapiens
tgagatcttgtggagctgggatcatgtttgaa

SEQ ID NO: 19035 - DNA, 32 bp, Homo sapiens
gaacctgggaggcagagcttgcagtgattgga

SEQ ID NO: 19036 - DNA, 32 bp, Homo sapiens
gaacctgggaggcagagcttgcagtgagctga

SEQ ID NO: 19037 - DNA, 32 bp, Homo sapiens
cagaccagaaatgactcacaccaccttatagc

SEQ ID NO: 19038 - DNA, 32 bp, Homo sapiens
caccaccaccttctccccatagcgactcttct

SEQ ID NO: 19039 - DNA, 31 bp, Homo sapiens
aggtggaactggaaacttaggagggaaagac

SEQ ID NO: 19040 - DNA, 32 bp, Homo sapiens
aatcaaaagagagcagggtggtattctacaaa

SEQ ID NO: 19041 - DNA, 23 bp, Homo sapiens
gtcgcccagactggagtgcagtg

SEQ ID NO: 19042 - DNA, 23 bp, Homo sapiens
gtcgcccagactagagtgcaatg

SEQ ID NO: 19043 - DNA, 32 bp, Homo sapiens
tgcctcctgagtagctgggactacaggcgcac

SEQ ID NO: 19044 - DNA, 32 bp, Homo sapiens
atgctgttgcccaggctggagtgcagtgtccc

SEQ ID NO: 19045 - DNA, 32 bp, Homo sapiens
ttgagacggagttttgctcttgttacccaggc

SEQ ID NO: 19046 - DNA, 32 bp, Homo sapiens
acctccgcctcctgggttcaaacaattctcct

SEQ ID NO: 19047 - DNA, 32 bp, Homo sapiens
gaacccaggaggtggaggttgcagtgagtcga

SEQ ID NO: 19048 - DNA, 32 bp, Homo sapiens
atgtgacagtgacacttcctggagtgtagagc

SEQ ID NO: 19049 - DNA, 32 bp, Homo sapiens
accttcgcctcccaggttcaagcaattctcct

SEQ ID NO: 19050 - DNA, 32 bp, Homo sapiens
gaacccgggaggcggaggttgtggtgagctga

SEQ ID NO: 19051 - DNA, 32 bp, Homo sapiens
gaactcaggaggtggaggttgcggtgagccaa

SEQ ID NO: 19052 - DNA, 32 bp, Homo sapiens
gaacccaggaggcggaggttgcggtgagccaa

SEQ ID NO: 19053 - DNA, 32 bp, Homo sapiens
gaacccagaaggcggaagttgcagtgagccga

SEQ ID NO: 19054 - DNA, 32 bp, Homo sapiens
gaacccgggaggcggaggttgcagtgagccaa

SEQ ID NO: 19055 - DNA, 32 bp, Homo sapiens
gaacccgggaggcggaggttgcggtgagccga

SEQ ID NO: 19056 - DNA, 32 bp, Homo sapiens
gaacctgggaggcgaaggttgcagtgagctga

SEQ ID NO: 19057 - DNA, 32 bp, Homo sapiens
gaacccaggaggcggaggttgcagtgagccga

SEQ ID NO: 19058 - DNA, 32 bp, Homo sapiens
gaacctgggaggcggaggttgcggtgagctga

SEQ ID NO: 19059 - DNA, 32 bp, Homo sapiens
ggagtacctcaagggccccggcctgggtggcg

SEQ ID NO: 19060 - DNA, 32 bp, Homo sapiens
tgtcttgaggttgtcagcaggtgcaagacacg

SEQ ID NO: 19061 - DNA, 32 bp, Homo sapiens
gaacctgggaggcggaggttgcagtgagctaa

SEQ ID NO: 19062 - DNA, 32 bp, Homo sapiens
ggcacagctccccagtctttgcttatgcccac

SEQ ID NO: 19063 - DNA, 32 bp, Homo sapiens
gcttccaggtatggagaaagagacaaagagga

SEQ ID NO: 19064 - DNA, 32 bp, Homo sapiens
ggcccacccaaccttgaagagagtcaagtcta

SEQ ID NO: 19065 - DNA, 32 bp, Homo sapiens
tctttgttgcccaggctggagtgcagtggcac

SEQ ID NO: 19066 - DNA, 32 bp, Homo sapiens
gcccaatagcccaggctggagtgcagtggcag

SEQ ID NO: 19067 - DNA, 32 bp, Homo sapiens
ctcttgttgcccaggcaggagtacaatggcag

SEQ ID NO: 19068 - DNA, 32 bp, Homo sapiens
tgtcaccccacaacaggaggggttagctgtgc

SEQ ID NO: 19069 - DNA, 32 bp, Homo sapiens
gatataaatgttcttaaactatgagtttaagc

SEQ ID NO: 19070 - DNA, 32 bp, Homo sapiens
gctttgtttcccaggctggagtgcagtggcac

SEQ ID NO: 19071 - DNA, 32 bp, Homo sapiens
tctcatttaagcaatttacttcctcattctgg

SEQ ID NO: 19072 - DNA, 32 bp, Homo sapiens
ataatgcggtgagcaggcaccacgccggcaga

SEQ ID NO: 19073 - DNA, 32 bp, Homo sapiens
ttgccccagccaacaggacgttcttgcacaac

SEQ ID NO: 19074 - DNA, 32 bp, Homo sapiens
agctggccaagtgcttgtgccagcagcatgga

SEQ ID NO: 19075 - DNA, 32 bp, Homo sapiens
ctcctggagagagtgaggagagtgtgtgatag

SEQ ID NO: 19076 - DNA, 28 bp, Homo sapiens
ataggtacaagtgctgctttgtcagcct

SEQ ID NO: 19077 - DNA, 21 bp, Homo sapiens
gccatcaggccccacccagga

SEQ ID NO: 19078 - DNA, 32 bp, Homo sapiens
ctcttctctcaaggagcacagtcctgggaaag

SEQ ID NO: 19079 - DNA, 32 bp, Homo sapiens
aattagcccaaaacagttgccaaactttgcca

SEQ ID NO: 19080 - DNA, 32 bp, Homo sapiens
aaagaaagagaaaaagaaagaaaggaaagaaa

SEQ ID NO: 19081 - DNA, 32 bp, Homo sapiens
ctgttctcagctctgtcatctgcggggcttct

SEQ ID NO: 19082 - DNA, 21 bp, Homo sapiens
tggggtctcgggtcactgcag

SEQ ID NO: 19083 - DNA, 32 bp, Homo sapiens
actccatcgtccaggctggagtgcagtggcgc

SEQ ID NO: 19084 - DNA, 32 bp, Homo sapiens
aagttagagtgagggaaatgagcttggcttct

SEQ ID NO: 19085 - DNA, 23 bp, Homo sapiens
gacacacatccatgacacagcct

SEQ ID NO: 19086 - DNA, 32 bp, Homo sapiens
ccaggctcaagtgatccttccacctcagcctc

SEQ ID NO: 19087 - DNA, 32 bp, Homo sapiens
caggccccgtccaccgcctccacgccgcacct

SEQ ID NO: 19088 - DNA, 32 bp, Homo sapiens
ataaatgaacaacataaaaacttttgttttga

SEQ ID NO: 19089 - DNA, 24 bp, Homo sapiens
tcacgcctgtaatcccggcacttt

SEQ ID NO: 19090 - DNA, 24 bp, Homo sapiens
tcacgcctataatcccagcacttt

SEQ ID NO: 19091 - DNA, 32 bp, Homo sapiens
tgactagtgatctcaggagatggcactgtcct

SEQ ID NO: 19092 - DNA, 32 bp, Homo sapiens
gcgtcccattttctcccctggcctcttacttg

SEQ ID NO: 19093 - DNA, 32 bp, Homo sapiens
ccacgtcaacttctcccacctgaccacaaagg

SEQ ID NO: 19094 - DNA, 32 bp, Homo sapiens
agctctcacacatgactggagagaagtgagaa

SEQ ID NO: 19095 - DNA, 32 bp, Homo sapiens
cccctctgcccaggctgccacgccctggatgc

SEQ ID NO: 19096 - DNA, 32 bp, Homo sapiens
cgtcttgtcctctcttctgcacagcacaggtt

SEQ ID NO: 19097 - DNA, 32 bp, Homo sapiens
ggtcaggccattctgttgcccacctcgtgctg

SEQ ID NO: 19098 - DNA, 32 bp, Homo sapiens
agcctcccaagtagctgggattacatgtgtgt

SEQ ID NO: 19099 - DNA, 32 bp, Homo sapiens
aaggctttgcaaactgtgaagtgcagtgccta

SEQ ID NO: 19100 - DNA, 32 bp, Homo sapiens
cactttgggaggcagaggccggtgggttgctt

SEQ ID NO: 19101 - DNA, 32 bp, Homo sapiens
gagcccgggaggcagaggctgcagtgaaccaa

SEQ ID NO: 19102 - DNA, 32 bp, Homo sapiens
gaacctgggaggcggagattgcagtgaaccaa

SEQ ID NO: 19103 - DNA, 32 bp, Homo sapiens
gaatccaggaggcagaggttgcagtgagtgga

SEQ ID NO: 19104 - DNA, 32 bp, Homo sapiens
ggagacaccagcaggtggctgcagtgacgtta

SEQ ID NO: 19105 - DNA, 32 bp, Homo sapiens
gagcccaggaggcagaggttgcagtaagccga

SEQ ID NO: 19106 - DNA, 32 bp, Homo sapiens
aagaccagccacctgtcacaggtgcagttgtc

SEQ ID NO: 19107 - DNA, 32 bp, Homo sapiens
cactgcttcagagacacgaaccaccttgagtg

SEQ ID NO: 19108 - DNA, 32 bp, Homo sapiens
ccacagcttcctgtccccatctgtcggcctac

SEQ ID NO: 19109 - DNA, 32 bp, Homo sapiens
tggaagaacaggagaaaaagaaaagcaaaaac

SEQ ID NO: 19110 - DNA, 32 bp, Homo sapiens
tggacttaggaaggagaaagaaacaagattaa

SEQ ID NO: 19111 - DNA, 32 bp, Homo sapiens
caataaagttgcatggtaaatatttcattaca

SEQ ID NO: 19112 - DNA, 32 bp, Homo sapiens
ccttgccctttgggctggagatgctttgccag

SEQ ID NO: 19113 - DNA, 32 bp, Homo sapiens
ctattgcatttcctactcctttgctacgtgta

SEQ ID NO: 19114 - DNA, 32 bp, Homo sapiens
cctcgcgacatcctgatctctcctgcaataac

SEQ ID NO: 19115 - DNA, 32 bp, Homo sapiens
ttacttctccaaataatgaactacctgattca

SEQ ID NO: 19116 - DNA, 32 bp, Homo sapiens
ccccgctgctcgggctggagaatagatggttt

SEQ ID NO: 19117 - DNA, 32 bp, Homo sapiens
ccatcttggccaggctggtgtgatcatggctc

SEQ ID NO: 19118 - DNA, 32 bp, Homo sapiens
aaacaacactggagagcagaggctgtggcttg

SEQ ID NO: 19119 - DNA, 32 bp, Homo sapiens
ctactcgggaggctgaggcaggagaatggctt

SEQ ID NO: 19120 - DNA, 32 bp, Homo sapiens
aaggaaactccaggacagcaccacctccccta

SEQ ID NO: 19121 - DNA, 32 bp, Homo sapiens
tcggtgtctgcagcaccctccgcttcctctcc

SEQ ID NO: 19122 - DNA, 21 bp, Homo sapiens
tgtgaagaactaaggtgggga

SEQ ID NO: 19123 - DNA, 32 bp, Homo sapiens
gctctgtcacccatcctggagtgcagtagtgt

SEQ ID NO: 19124 - DNA, 32 bp, Homo sapiens
tctctgttgcccaggctggagtgcaatggcac

SEQ ID NO: 19125 - DNA, 32 bp, Homo sapiens
gaaaagctttgtttgttcttgtttttaagttt

SEQ ID NO: 19126 - DNA, 32 bp, Homo sapiens
gttctcccaacaacatgaaactgcctattcac

SEQ ID NO: 19127 - DNA, 32 bp, Homo sapiens
cgtgtggggagctgggtgtgtgatctggccag

SEQ ID NO: 19128 - DNA, 32 bp, Homo sapiens
tttgattgaacacaggcttgacagaatcttct

SEQ ID NO: 19129 - DNA, 28 bp, Homo sapiens
ggagcccccagcccagcctcatcctgga

SEQ ID NO: 19130 - DNA, 32 bp, Homo sapiens
ctactcgggaggctgaggcaggaagaatcgct

SEQ ID NO: 19131 - DNA, 32 bp, Homo sapiens
aggcgcgggaggcggcagccgcagcgaggagg

SEQ ID NO: 19132 - DNA, 32 bp, Homo sapiens
gaaccccagaggcagaggttgcagtgagctga

SEQ ID NO: 19133 - DNA, 16 bp, Homo sapiens
gcccctgccccaggtg

SEQ ID NO: 19134 - DNA, 24 bp, Homo sapiens
tcaggcctgtaatcccagcacttt

SEQ ID NO: 19135 - DNA, 32 bp, Homo sapiens
gaggggaagagaagagaaagagggggaaagga

SEQ ID NO: 19136 - DNA, 32 bp, Homo sapiens
tcttgttgcccagcctggagtgcaatagcgtg

SEQ ID NO: 19137 - DNA, 32 bp, Homo sapiens
tgctcttctgcagcctcatctctgccattctt

SEQ ID NO: 19138 - DNA, 18 bp, Homo sapiens
gcccctgccctaccccag

SEQ ID NO: 19139 - DNA, 32 bp, Homo sapiens
gtttttgctgtagccctagagcactttgtttg

SEQ ID NO: 19140 - DNA, 32 bp, Homo sapiens
cccatgaaagagacccagtggttactgtgcac

SEQ ID NO: 19141 - DNA, 32 bp, Homo sapiens
gctgtgttgcccaggctggagtgcggtggcta

SEQ ID NO: 19142 - DNA, 32 bp, Homo sapiens
acctccacctccctggttcaagcgattctcct

SEQ ID NO: 19143 - DNA, 32 bp, Homo sapiens
gcctccgcttcctgggttcaagcgattctcct

SEQ ID NO: 19144 - DNA, 32 bp, Homo sapiens
tcatttcattttattcccatctgttttcaaac

SEQ ID NO: 19145 - DNA, 32 bp, Homo sapiens
cgatcaaggtcaagagaaagaaaacgaaagtc

SEQ ID NO: 19146 - DNA, 32 bp, Homo sapiens
cccgctccctagagcaggagatcttgagtggg

SEQ ID NO: 19147 - DNA, 32 bp, Homo sapiens
gatggtccactctgtacacaggcattcctcct

SEQ ID NO: 19148 - DNA, 32 bp, Homo sapiens
ctgtcccctgcagcttccgtggtgcctttgct

SEQ ID NO: 19149 - DNA, 32 bp, Homo sapiens
tagtttagggatctctggaaatgtcagtttcc

SEQ ID NO: 19150 - DNA, 32 bp, Homo sapiens
cgctgcgcctccaggctggaccagcagttcca

SEQ ID NO: 19151 - DNA, 32 bp, Homo sapiens
aaggacttgccaggctggacaatgcccgttga

SEQ ID NO: 19152 - DNA, 23 bp, Homo sapiens
tggcactatcttggcttactgca

SEQ ID NO: 19153 - DNA, 32 bp, Homo sapiens
tggtcttgcccagctgggctgcctcaggtgtc

SEQ ID NO: 19154 - DNA, 32 bp, Homo sapiens
tgaacggggcggcaggcttctcgagctccggg

SEQ ID NO: 19155 - DNA, 32 bp, Homo sapiens
gttctgtcactcaggctggagtacagtggtgc

SEQ ID NO: 19156 - DNA, 32 bp, Homo sapiens
acctccgcctcctgggttcgggcgattctcct

SEQ ID NO: 19157 - DNA, 32 bp, Homo sapiens
atttagtcacccagaggagccagtaaatgtta

SEQ ID NO: 19158 - DNA, 23 bp, Homo sapiens
tttactggtagtgttctgatttg

SEQ ID NO: 19159 - DNA, 32 bp, Homo sapiens
tatgcatgttctgactgacaccatcttgatgc

SEQ ID NO: 19160 - DNA, 32 bp, Homo sapiens
tctccttttcttctcctttctgctgaccagaa

SEQ ID NO: 19161 - DNA, 32 bp, Homo sapiens
tttagacagagttttgctcttgttgcctaggc

SEQ ID NO: 19162 - DNA, 32 bp, Homo sapiens
tagagagggagtttcgccatgttggccaggct

SEQ ID NO: 19163 - DNA, 21 bp, Homo sapiens
cgggagcctgaggcaggagaa

SEQ ID NO: 19164 - DNA, 32 bp, Homo sapiens
acctcgacctcttgggttcaagtgattctcct

SEQ ID NO: 19165 - DNA, 32 bp, Homo sapiens
aacagactcaaggagacaaccacctcaactgg

SEQ ID NO: 19166 - DNA, 32 bp, Homo sapiens
ccaggttccagcaattctcctgcctcagcctc

SEQ ID NO: 19167 - DNA, 23 bp, Homo sapiens
tcatgcctgtaatccagtacttt

SEQ ID NO: 19168 - DNA, 32 bp, Homo sapiens
tgatgggggaggcaagagagggcaaagagtaa

SEQ ID NO: 19169 - DNA, 32 bp, Homo sapiens
acctccgcctcccaggttcaagcaattctcct

SEQ ID NO: 19170 - DNA, 22 bp, Homo sapiens
gtcgcccaggctggagtgcagt

SEQ ID NO: 19171 - DNA, 21 bp, Homo sapiens
gtcacccgggctggagtgtaa

SEQ ID NO: 19172 - DNA, 32 bp, Homo sapiens
ttagtgcatcttctccaagaagggccgttcat

SEQ ID NO: 19173 - DNA, 32 bp, Homo sapiens
ccaggttcaagcaattatcctgcctcagcctc

SEQ ID NO: 19174 - DNA, 32 bp, Homo sapiens
tgtggaaggttctgagaaagaaaatagtttcc

SEQ ID NO: 19175 - DNA, 32 bp, Homo sapiens
caatctttccttctgtcaacggcaggggcagg

SEQ ID NO: 19176 - DNA, 32 bp, Homo sapiens
ctttctcaacatcttcatgttgaagctaaaac

SEQ ID NO: 19177 - DNA, 32 bp, Homo sapiens
gatctcgcctcctgggttcaagcgattctcct

SEQ ID NO: 19178 - DNA, 28 bp, Homo sapiens
cacagcctgggaggcgcctcatccagaa

SEQ ID NO: 19179 - DNA, 32 bp, Homo sapiens
ctttcagttttctcttctgtgaaacaggaaga

SEQ ID NO: 19180 - DNA, 32 bp, Homo sapiens
tgttccatgcagtcactcagggacccagtctc

SEQ ID NO: 19181 - DNA, 32 bp, Homo sapiens
gctttgaagtttgcgtcttttctgcctctttc

SEQ ID NO: 19182 - DNA, 32 bp, Homo sapiens
aaattaggtttacttcttgtctctccaagtgg

SEQ ID NO: 19183 - DNA, 32 bp, Homo sapiens
tgtctgtccctcacagcaccaaatgttccctg

SEQ ID NO: 19184 - DNA, 18 bp, Homo sapiens
gcaaaattccacccagaa

SEQ ID NO: 19185 - DNA, 32 bp, Homo sapiens
agcctcctgagtagctgagaccacaggcgtgt

SEQ ID NO: 19186 - DNA, 32 bp, Homo sapiens
gctaatagagaaggagaaaggaaataaaataa

SEQ ID NO: 19187 - DNA, 32 bp, Homo sapiens
acgcccccagttccacaccatgggtgttggat

SEQ ID NO: 19188 - DNA, 28 bp, Homo sapiens
atttacccaagtgttcagcttattcacc

SEQ ID NO: 19189 - DNA, 32 bp, Homo sapiens
acattcagtgccaagtgctcccatgggaataa

SEQ ID NO: 19190 - DNA, 32 bp, Homo sapiens
ttttctctgaccacctgcagcctgttgaagga

SEQ ID NO: 19191 - DNA, 32 bp, Homo sapiens
acttccacttcccgggttcaagcgattctcct

SEQ ID NO: 19192 - DNA, 32 bp, Homo sapiens
gaacccaggaggcggaggttgcagtgagccag

SEQ ID NO: 19193 - DNA, 32 bp, Homo sapiens
ctactcgggaggctgaggcaggaggatcgctt

SEQ ID NO: 19194 - DNA, 32 bp, Homo sapiens
cagcccttgaggcagaggtgccgagtgactgc

SEQ ID NO: 19195 - DNA, 32 bp, Homo sapiens
ggccacgggaggcggggctgcatggctggggg

SEQ ID NO: 19196 - DNA, 32 bp, Homo sapiens
gaacccgagaggcggaggttgcagtgagccga

SEQ ID NO: 19197 - DNA, 32 bp, Homo sapiens
tccatgtgggagcagaggtgtgaagagaattt

SEQ ID NO: 19198 - DNA, 24 bp, Homo sapiens
tcacgcctgtaatcccagcccttt

SEQ ID NO: 19199 - DNA, 24 bp, Homo sapiens
tcaagcctgtaatcccagcacttt

SEQ ID NO: 19200 - DNA, 32 bp, Homo sapiens
gaacccaagaggcggaggttgcagtgagccaa

SEQ ID NO: 19201 - DNA, 32 bp, Homo sapiens
ttgtggtttcctctttaagacagggtcttgct

SEQ ID NO: 19202 - DNA, 20 bp, Homo sapiens
tggaggatggagagagggga

SEQ ID NO: 19203 - DNA, 32 bp, Homo sapiens
gtttgacattggagatacgctagtaactgtga

SEQ ID NO: 19204 - DNA, 32 bp, Homo sapiens
gctctgtcacccaggctggagtgcagtggccc

SEQ ID NO: 19205 - DNA, 32 bp, Homo sapiens
ctttgtcagccaggctggagtgcaatgtgcaa

SEQ ID NO: 19206 - DNA, 32 bp, Homo sapiens
ctctgtcgccaaggctggagggcaatggcatg

SEQ ID NO: 19207 - DNA, 32 bp, Homo sapiens
atgcagagcctgcactctggcactcgctgaag

SEQ ID NO: 19208 - DNA, 32 bp, Homo sapiens
agcctcctgagtagctgggactacagatgtag

SEQ ID NO: 19209 - DNA, 32 bp, Homo sapiens
cagtactgtgttcttcagctagaggcagcttt

SEQ ID NO: 19210 - DNA, 32 bp, Homo sapiens
gagcccaggagtttgaggttgcagtgagctgt

SEQ ID NO: 19211 - DNA, 32 bp, Homo sapiens
gggcccaggagatggaggttgcggtgagtggg

SEQ ID NO: 19212 - DNA, 32 bp, Homo sapiens
acctccgccccctgggtttaagcgattctcct

SEQ ID NO: 19213 - DNA, 32 bp, Homo sapiens
cacatctgttggagagataatcactccttttc

SEQ ID NO: 19214 - DNA, 32 bp, Homo sapiens
taagggggaagaggagagggtatggggcggca

SEQ ID NO: 19215 - DNA, 32 bp, Homo sapiens
gtaacctcagttaactttaacaacaagcattc

SEQ ID NO: 19216 - DNA, 18 bp, Homo sapiens
cagaatagctgggcccag

SEQ ID NO: 19217 - DNA, 32 bp, Homo sapiens
ggtgtccatcctttccccatccctgcctcctg

SEQ ID NO: 19218 - DNA, 32 bp, Homo sapiens
ggaccccataatctgcccatctgggacttggc

SEQ ID NO: 19219 - DNA, 32 bp, Homo sapiens
ctctgtctcccaggctgaagtgcagtggcacg

SEQ ID NO: 19220 - DNA, 32 bp, Homo sapiens
ctctgtcactcaggctggagtgcagtggtata

SEQ ID NO: 19221 - DNA, 32 bp, Homo sapiens
ttgggagcctgaggggccatctccctgacact

SEQ ID NO: 19222 - DNA, 32 bp, Homo sapiens
cagggctgagtgggctgggatctcgtgtcctc

SEQ ID NO: 19223 - DNA, 32 bp, Homo sapiens
tcaaattagatgtttcaactgtgctcctgttt

SEQ ID NO: 19224 - DNA, 32 bp, Homo sapiens
acctgggcctgcattccatccgctctgcagcc

SEQ ID NO: 19225 - DNA, 32 bp, Homo sapiens
atagtttgcagtttctgggaagcaattgaaac

SEQ ID NO: 19226 - DNA, 32 bp, Homo sapiens
ttatgcttagcagcttcttcactgttttgaaa

SEQ ID NO: 19227 - DNA, 19 bp, Homo sapiens
gcccctgcaggtccaggtg

SEQ ID NO: 19228 - DNA, 32 bp, Homo sapiens
gagatcaggaaagacttcctggccaacatgag

SEQ ID NO: 19229 - DNA, 24 bp, Homo sapiens
tggcacaatcacggctcactgcag

SEQ ID NO: 19230 - DNA, 32 bp, Homo sapiens
gcagtgtttgtgtccctgattacttgagatta

SEQ ID NO: 19231 - DNA, 32 bp, Homo sapiens
ccctctcctgctgctggacttctgcctttgtt

SEQ ID NO: 19232 - DNA, 32 bp, Homo sapiens
aattaagtgccaggctgggcacaatggctcgt

SEQ ID NO: 19233 - DNA, 32 bp, Homo sapiens
ctctgtcgcccaggctggagtgcaatggcgcg

SEQ ID NO: 19234 - DNA, 32 bp, Homo sapiens
cactttcacagacctaatctttgtttgcaaac

SEQ ID NO: 19235 - DNA, 32 bp, Homo sapiens
catcggttgcccaaggctgtaagtagtgatgg

SEQ ID NO: 19236 - DNA, 32 bp, Homo sapiens
ctctgtcacccaggctggagtgcgatggcgcg

SEQ ID NO: 19237 - DNA, 32 bp, Homo sapiens
ctctgtcgcccaggctagagtgcagtggcgcg

SEQ ID NO: 19238 - DNA, 32 bp, Homo sapiens
ggcttatgcctgtaatcccagcactttgggag

SEQ ID NO: 19239 - DNA, 32 bp, Homo sapiens
ggctcatgcctgcaatcccagcactttgggag

SEQ ID NO: 19240 - DNA, 32 bp, Homo sapiens
ctctgtcaaccaggctggagtgcactggcgca

SEQ ID NO: 19241 - DNA, 32 bp, Homo sapiens
gaacccggtaggtggaggttgcagtgagccga

SEQ ID NO: 19242 - DNA, 32 bp, Homo sapiens
gaacccgggaggtggaggttgcagggagccga

SEQ ID NO: 19243 - DNA, 28 bp, Homo sapiens
ctcaagatctgtgctgcctcctcaggag

SEQ ID NO: 19244 - DNA, 24 bp, Homo sapiens
tcacacctgtaatcctagcacttt

SEQ ID NO: 19245 - DNA, 32 bp, Homo sapiens
aagccaagaagaggaaacaagataataaatgt

SEQ ID NO: 19246 - DNA, 32 bp, Homo sapiens
gaacctgggaggtggatgttgcagtgagctga

SEQ ID NO: 19247 - DNA, 32 bp, Homo sapiens
gaaaatgattgtttagcatctttacagatgga

SEQ ID NO: 19248 - DNA, 24 bp, Homo sapiens
tcacacctataatcctggcacttt

SEQ ID NO: 19249 - DNA, 24 bp, Homo sapiens
tcacacccgtaatcccagcacttt

SEQ ID NO: 19250 - DNA, 32 bp, Homo sapiens
taattatgcatcctagctaaggcacagaagac

SEQ ID NO: 19251 - DNA, 24 bp, Homo sapiens
ctgtcatctaggctggagtgcagt

SEQ ID NO: 19252 - DNA, 32 bp, Homo sapiens
ttcatttccaaaacatccatctttctccactt

SEQ ID NO: 19253 - DNA, 32 bp, Homo sapiens
cctctgagaataggagaaatgaagcaacagtt

SEQ ID NO: 19254 - DNA, 32 bp, Homo sapiens
gctatctcagttctgtagcagatccctggttc

SEQ ID NO: 19255 - DNA, 32 bp, Homo sapiens
ggtctggatacttgctatgattttcacttttt

SEQ ID NO: 19256 - DNA, 32 bp, Homo sapiens
cctatcagctttgtttcgcctgatctcaagtt

SEQ ID NO: 19257 - DNA, 32 bp, Homo sapiens
gctctgtcgcccaggctggagtgagtgcagtg

SEQ ID NO: 19258 - DNA, 32 bp, Homo sapiens
tggaggttacacagggtaaagtgcagtatgat

SEQ ID NO: 19259 - DNA, 32 bp, Homo sapiens
ctgggttcaagcaattttcctgcctcagcctc

SEQ ID NO: 19260 - DNA, 32 bp, Homo sapiens
cctggctccctgcactgtgcacgctcctcttc

SEQ ID NO: 19261 - DNA, 32 bp, Homo sapiens
agcctcctgagtagctgggactacaggtgcgt

SEQ ID NO: 19262 - DNA, 32 bp, Homo sapiens
gagcccaggaggcacaggctgcagtgagcaga

SEQ ID NO: 19263 - DNA, 32 bp, Homo sapiens
ctcttggggaggcagaggcaggaggatcgctt

SEQ ID NO: 19264 - DNA, 32 bp, Homo sapiens
ttcatacaacatcagtggttacagctatacta

SEQ ID NO: 19265 - DNA, 24 bp, Homo sapiens
tggcatgatctcagctcactgcag

SEQ ID NO: 19266 - DNA, 32 bp, Homo sapiens
gagaaaagagcctcagcaagagagttttgcca

SEQ ID NO: 19267 - DNA, 32 bp, Homo sapiens
aaaagcaatttccaaaaatgaaacccattcat

SEQ ID NO: 19268 - DNA, 32 bp, Homo sapiens
gctctgtctcccaggctggagtgcggtggcac

SEQ ID NO: 19269 - DNA, 32 bp, Homo sapiens
cgactccacatcctctgcacatgctacctaca

SEQ ID NO: 19270 - DNA, 32 bp, Homo sapiens
actagtaggcaggtttctcttgttgtctagac

SEQ ID NO: 19271 - DNA, 32 bp, Homo sapiens
agcctcccgagtagctgggattacaggcgtgc

SEQ ID NO: 19272 - DNA, 32 bp, Homo sapiens
tcaatggtgcccaggctggagtgcagtggcgt

SEQ ID NO: 19273 - DNA, 32 bp, Homo sapiens
actctgtctcccaggctggagtgcagtggcac

SEQ ID NO: 19274 - DNA, 32 bp, Homo sapiens
agcctcctgagtagctgggattacaggcgtgt

SEQ ID NO: 19275 - DNA, 32 bp, Homo sapiens
agccacctgagtagctgggagtacaggcatgt

SEQ ID NO: 19276 - DNA, 32 bp, Homo sapiens
agcctcctgagtagctgggattataggcgtgc

SEQ ID NO: 19277 - DNA, 32 bp, Homo sapiens
tcaggctcaagcaatcctcccgcctcagcctt

SEQ ID NO: 19278 - DNA, 32 bp, Homo sapiens
gaacccgggaggcagaggctgtagtgagccaa

SEQ ID NO: 19279 - DNA, 32 bp, Homo sapiens
accaccacttcctgggttcaagcgattctcct

SEQ ID NO: 19280 - DNA, 28 bp, Homo sapiens
ttgcagctcggctgtgcctcatcttccc

SEQ ID NO: 19281 - DNA, 23 bp, Homo sapiens
tggcacaatctcggctcactgca

SEQ ID NO: 19282 - DNA, 23 bp, Homo sapiens
tggcgcaatctcagctcactgca

SEQ ID NO: 19283 - DNA, 32 bp, Homo sapiens
tcacccatctttgttcccatctgaggactcag

SEQ ID NO: 19284 - DNA, 32 bp, Homo sapiens
gtagacgccatgatggatgtgtctggtgtggg

SEQ ID NO: 19285 - DNA, 32 bp, Homo sapiens
tgcatccctcccccactggagtgatttcagtg

SEQ ID NO: 19286 - DNA, 32 bp, Homo sapiens
ctctgtcacccaggctgggatgcagtggcttc

SEQ ID NO: 19287 - DNA, 32 bp, Homo sapiens
aaacctgggaggcgaagattgcagtgagctga

SEQ ID NO: 19288 - DNA, 32 bp, Homo sapiens
aaacccgggaggcggagattgcagtgagccaa

SEQ ID NO: 19289 - DNA, 28 bp, Homo sapiens
aggaagccgactgctgcctggtctgcaa

SEQ ID NO: 19290 - DNA, 24 bp, Homo sapiens
tcacgcctgtagtcccagcacttt

SEQ ID NO: 19291 - DNA, 24 bp, Homo sapiens
tcacgcctgtaatcccagcgcttt

SEQ ID NO: 19292 - DNA, 24 bp, Homo sapiens
tcatgcctgtaatcttagtacttt

SEQ ID NO: 19293 - DNA, 32 bp, Homo sapiens
gactgctgtgggctgctcactggctttagctg

SEQ ID NO: 19294 - DNA, 19 bp, Homo sapiens
tgtgtcaaagagatgagga

SEQ ID NO: 19295 - DNA, 32 bp, Homo sapiens
tttctacatcttcattatttggacctaaaacc

SEQ ID NO: 19296 - DNA, 32 bp, Homo sapiens
gtagacaagtctctctcataccaacagaactt

SEQ ID NO: 19297 - DNA, 32 bp, Homo sapiens
caagtttgaagtttcgccgcttttgtcaacta

SEQ ID NO: 19298 - DNA, 32 bp, Homo sapiens
ccacagacccccagcaggtagcattccccagc

SEQ ID NO: 19299 - DNA, 32 bp, Homo sapiens
ctctgttgctcaggctggagtgcagtggcacc

SEQ ID NO: 19300 - DNA, 32 bp, Homo sapiens
gctttgtcgcccaggctggagtgcaatgcacg

SEQ ID NO: 19301 - DNA, 32 bp, Homo sapiens
tcttgtagcccaggctgggatgcaatggcatg

SEQ ID NO: 19302 - DNA, 32 bp, Homo sapiens
accctcccgagtagctgggattacaggcacac

SEQ ID NO: 19303 - DNA, 32 bp, Homo sapiens
agcctcctgagtagctgtactacaggaatgca

SEQ ID NO: 19304 - DNA, 32 bp, Homo sapiens
aagtcccaggacggtggaaactagctagtaga

SEQ ID NO: 19305 - DNA, 32 bp, Homo sapiens
cctgacacccttctccccttcctggtagacct

SEQ ID NO: 19306 - DNA, 31 bp, Homo sapiens
tgagaaagcaagacatcaaggagggacctgt

SEQ ID NO: 19307 - DNA, 32 bp, Homo sapiens
ctctggtgttcagtgaggaggacatgtgagtc

SEQ ID NO: 19308 - DNA, 21 bp, Homo sapiens
cccaggatttccacagcacac

SEQ ID NO: 19309 - DNA, 32 bp, Homo sapiens
agttcatagtgaagtttccactgtgagcggca

SEQ ID NO: 19310 - DNA, 22 bp, Homo sapiens
gggaggcagcccttcccaggga

SEQ ID NO: 19311 - DNA, 32 bp, Homo sapiens
cccccagatgttcttccctgggtgttgatggc

SEQ ID NO: 19312 - DNA, 32 bp, Homo sapiens
actgcagcctccacttcctgggttcacatgat

SEQ ID NO: 19313 - DNA, 32 bp, Homo sapiens
ctcatcacttcctaattattttgctacatttc

SEQ ID NO: 19314 - DNA, 32 bp, Homo sapiens
gactaggggcctgggtggcctcattaactcta

SEQ ID NO: 19315 - DNA, 32 bp, Homo sapiens
atatacccaacaactggaattgtttacacatg

SEQ ID NO: 19316 - DNA, 32 bp, Homo sapiens
tcagtctccacaacaggacgaagctggctgag

SEQ ID NO: 19317 - DNA, 28 bp, Homo sapiens
agacccagaagttctgcctcactcccag

SEQ ID NO: 19318 - DNA, 32 bp, Homo sapiens
ctcaaaatgagatactgacaccacctttgccc

SEQ ID NO: 19319 - DNA, 32 bp, Homo sapiens
ctgcatggcaggcagaggcccagggacactga

SEQ ID NO: 19320 - DNA, 32 bp, Homo sapiens
ttcatctgtaccacaccctggtgaaacctttg

SEQ ID NO: 19321 - DNA, 32 bp, Homo sapiens
aacagctcagttctgtcatccaggacatggcc

SEQ ID NO: 19322 - DNA, 32 bp, Homo sapiens
tccctgctgccacttatcccagctccaagttt

SEQ ID NO: 19323 - DNA, 32 bp, Homo sapiens
taccttcaaggctcttcttcctcaccgagcat

SEQ ID NO: 19324 - DNA, 32 bp, Homo sapiens
agtatatcaagcaataatctcccacccaaggc

SEQ ID NO: 19325 - DNA, 32 bp, Homo sapiens
ctctgtcccccaggctggagtgcagtggctcg

SEQ ID NO: 19326 - DNA, 32 bp, Homo sapiens
cctgatttgagaagctgaagaaaacaaaattt

SEQ ID NO: 19327 - DNA, 28 bp, Homo sapiens
ccactggtcggtgctgcctggtcctggc

SEQ ID NO: 19328 - DNA, 32 bp, Homo sapiens
tgcatgagctctccttcccagagaccaactct

SEQ ID NO: 19329 - DNA, 32 bp, Homo sapiens
actgaaagaagatatttcaagatgaccatctg

SEQ ID NO: 19330 - DNA, 32 bp, Homo sapiens
ccatcctggaggcagcaggtcgggtagagtga

SEQ ID NO: 19331 - DNA, 32 bp, Homo sapiens
ctctgtcacccaggctggagtgcaatgacgca

SEQ ID NO: 19332 - DNA, 32 bp, Homo sapiens
ttaagactgagtttcactcttgttgcccaggc

SEQ ID NO: 19333 - DNA, 32 bp, Homo sapiens
cctgaggagccagcgggccgcaagcaagttgc

SEQ ID NO: 19334 - DNA, 32 bp, Homo sapiens
acatctgtctccattcctgccatctcttcctg

SEQ ID NO: 19335 - DNA, 32 bp, Homo sapiens
atggcaccctgagacagcccagaggtgaatag

SEQ ID NO: 19336 - DNA, 32 bp, Homo sapiens
ttctgtttcccaggctggagtgcagtggtggg

SEQ ID NO: 19337 - DNA, 32 bp, Homo sapiens
ggctcgtatctgtaatcccagcactttgagag

SEQ ID NO: 19338 - DNA, 32 bp, Homo sapiens
ttcaagaagttaattgctatgtggaaagaagg

SEQ ID NO: 19339 - DNA, 32 bp, Homo sapiens
ctctgttgcccgggctggagtacaatggcatg

SEQ ID NO: 19340 - DNA, 28 bp, Homo sapiens
aagctcccaagtgttgctggatctctgc

SEQ ID NO: 19341 - DNA, 32 bp, Homo sapiens
cagtgtcagcatgactctcccacttggaaaga

SEQ ID NO: 19342 - DNA, 32 bp, Homo sapiens
actctgtcacccaggctggagtgcagtagcgc

SEQ ID NO: 19343 - DNA, 32 bp, Homo sapiens
gaataatcattgagacagagtcactgtctttc

SEQ ID NO: 19344 - DNA, 32 bp, Homo sapiens
cggctggaaagaggagaaggagagggagtaca

SEQ ID NO: 19345 - DNA, 32 bp, Homo sapiens
acgtagaggcagacccatgtgctgctgttgca

SEQ ID NO: 19346 - DNA, 28 bp, Homo sapiens
tagaaaacaagtgctttttatcttgaaa

SEQ ID NO: 19347 - DNA, 32 bp, Homo sapiens
acccactctcttctccccctgacccccgctcc

SEQ ID NO: 19348 - DNA, 32 bp, Homo sapiens
ggtcctgcacttctccccagaggtgggccctc

SEQ ID NO: 19349 - DNA, 32 bp, Homo sapiens
gtgccagttgccagggcaagtcactgcgctgg

SEQ ID NO: 19350 - DNA, 32 bp, Homo sapiens
ctgctttggagcaaatctcttctgtttagaga

SEQ ID NO: 19351 - DNA, 32 bp, Homo sapiens
gggagctgcctggcttctctgcctccagcctt

SEQ ID NO: 19352 - DNA, 18 bp, Homo sapiens
cacacctctccacagggc

SEQ ID NO: 19353 - DNA, 32 bp, Homo sapiens
catgggctgctgctgtcactccctctccactt

SEQ ID NO: 19354 - DNA, 32 bp, Homo sapiens
taaatcttgctgctgttcattgtttgggtcca

SEQ ID NO: 19355 - DNA, 32 bp, Homo sapiens
aagtcctcccaccttgaagagacaggctctga

SEQ ID NO: 19356 - DNA, 32 bp, Homo sapiens
aacgggaaagagaaagagacattcacttggag

SEQ ID NO: 19357 - DNA, 32 bp, Homo sapiens
ctctgtcatgcaggctggagtgcggtggtgcg

SEQ ID NO: 19358 - DNA, 24 bp, Homo sapiens
caggctctgtgctccttccagccc

SEQ ID NO: 19359 - DNA, 32 bp, Homo sapiens
agttctagattgatctctgaatgtgatcgacg

SEQ ID NO: 19360 - DNA, 32 bp, Homo sapiens
cactatcacccaggctggagtgcagtggcata

SEQ ID NO: 19361 - DNA, 32 bp, Homo sapiens
cttgctcgcccagggtggagtgcagtggtgtg

SEQ ID NO: 19362 - DNA, 23 bp, Homo sapiens
tcagaaggctgtctggcacccag

SEQ ID NO: 19363 - DNA, 32 bp, Homo sapiens
cctattcaagacgtcctggaaaactacattta

SEQ ID NO: 19364 - DNA, 32 bp, Homo sapiens
agcgaaaccagcttcatctcccagagaatggg

SEQ ID NO: 19365 - DNA, 32 bp, Homo sapiens
ctacagttctgagcatgacactagccttctct

SEQ ID NO: 19366 - DNA, 32 bp, Homo sapiens
tgagaaaactctttggtgcttctgcctttagt

SEQ ID NO: 19367 - DNA, 32 bp, Homo sapiens
tagagatgcagcatttgtaatatttcatcccc

SEQ ID NO: 19368 - DNA, 32 bp, Homo sapiens
cctgaacatccctcctttcaggctgcagaagg

SEQ ID NO: 19369 - DNA, 22 bp, Homo sapiens
cgtcgcccaggctggagtgcag

SEQ ID NO: 19370 - DNA, 32 bp, Homo sapiens
ctgatatcacccaggctggagtgcagtggcgc

SEQ ID NO: 19371 - DNA, 32 bp, Homo sapiens
tgtgctccttggagctggtgtgcagtgtcctg

SEQ ID NO: 19372 - DNA, 32 bp, Homo sapiens
tttacggaagggggaaacagaaaacagcctcc

SEQ ID NO: 19373 - DNA, 32 bp, Homo sapiens
gtggaaaatgttcttgatcatttgcagttaag

SEQ ID NO: 19374 - DNA, 32 bp, Homo sapiens
gcctttcccactggtccatctggttttctctc

SEQ ID NO: 19375 - DNA, 32 bp, Homo sapiens
ccgcagaagggcagcggtgcactgtgatgcct

SEQ ID NO: 19376 - DNA, 32 bp, Homo sapiens
atggggctcaggtctgtcacttaacttagagt

SEQ ID NO: 19377 - DNA, 32 bp, Homo sapiens
tagagatggagagaaatggtgtggaaacattt

SEQ ID NO: 19378 - DNA, 32 bp, Homo sapiens
atgcagattcccaggctgggtgcagtggctca

SEQ ID NO: 19379 - DNA, 32 bp, Homo sapiens
gagccctggagttggaggttgcagtgagcaga

SEQ ID NO: 19380 - DNA, 32 bp, Homo sapiens
atcctcaaggattttatcctggaacattacag

SEQ ID NO: 19381 - DNA, 32 bp, Homo sapiens
gctaaatcggttcagactcccacctcaccgtt

SEQ ID NO: 19382 - DNA, 18 bp, Homo sapiens
cagggaagggccaagccc

SEQ ID NO: 19383 - DNA, 32 bp, Homo sapiens
ctcacatcctttgaagatgaccaccttgaaga

SEQ ID NO: 19384 - DNA, 32 bp, Homo sapiens
ctgggtcccaggagccttaacaaggcattgag

SEQ ID NO: 19385 - DNA, 32 bp, Homo sapiens
cttgttgcccagggctggagtgcagtggcatg

SEQ ID NO: 19386 - DNA, 32 bp, Homo sapiens
cctgagaagccagacttccactgtggaagagc

SEQ ID NO: 19387 - DNA, 32 bp, Homo sapiens
cttggctctgaagctggccactgtgggctgca

SEQ ID NO: 19388 - DNA, 32 bp, Homo sapiens
tcggggtcgggaggcgtccccacgccgcccgg

SEQ ID NO: 19389 - DNA, 32 bp, Homo sapiens
cagcttcctagtagctgggattgcaggcactc

SEQ ID NO: 19390 - DNA, 32 bp, Homo sapiens
gcagatagggtagaggaaagggtctagaatat

SEQ ID NO: 19391 - DNA, 28 bp, Homo sapiens
gtccagccaggggctgcctccatgtcct

SEQ ID NO: 19392 - DNA, 32 bp, Homo sapiens
tgaaagaaaaggaagcaaagaaaatagctgcc

SEQ ID NO: 19393 - DNA, 32 bp, Homo sapiens
gaacctaggaggcagagtttgcagtgagctga

SEQ ID NO: 19394 - DNA, 32 bp, Homo sapiens
ctccgtcaacatctgctgctccaagctggtga

SEQ ID NO: 19395 - DNA, 22 bp, Homo sapiens
ccttagcagctcacaacatccc

SEQ ID NO: 19396 - DNA, 31 bp, Homo sapiens
aagttcatgtctcatgttatctggaccttga

SEQ ID NO: 19397 - DNA, 24 bp, Homo sapiens
tcatacctgtaatgccagcacttt

SEQ ID NO: 19398 - DNA, 32 bp, Homo sapiens
gctggggaggtagaggaaagtgctagagtaca

SEQ ID NO: 19399 - DNA, 32 bp, Homo sapiens
gttgctgcagaacagtccatactgtggggctg

SEQ ID NO: 19400 - DNA, 21 bp, Homo sapiens
tggcacgatcatagctcactg

SEQ ID NO: 19401 - DNA, 32 bp, Homo sapiens
tcttgttgcccgggctggagtgcaatggcgcg

SEQ ID NO: 19402 - DNA, 32 bp, Homo sapiens
tcttgttgcccaggctggaatgcaatggcgcg

SEQ ID NO: 19403 - DNA, 32 bp, Homo sapiens
tgtagtttgcccagagttgggggctaggggag

SEQ ID NO: 19404 - DNA, 28 bp, Homo sapiens
aatcttttaagtgctgaacttatttttc

SEQ ID NO: 19405 - DNA, 32 bp, Homo sapiens
cctctacatcttcaccaagatctcgggatcct

SEQ ID NO: 19406 - DNA, 32 bp, Homo sapiens
cttctgcacaggagagcaaggcacttgcagta

SEQ ID NO: 19407 - DNA, 28 bp, Homo sapiens
gtttccgccatggatgcctcatcaccaa

SEQ ID NO: 19408 - DNA, 32 bp, Homo sapiens
ctctgcagcctttcacttcagtgcccacctgg

SEQ ID NO: 19409 - DNA, 32 bp, Homo sapiens
ttttatctggtgtttttacttctgcctgcgtt

SEQ ID NO: 19410 - DNA, 32 bp, Homo sapiens
cttggaatttgggatcctcttctgtctcttga

SEQ ID NO: 19411 - DNA, 21 bp, Homo sapiens
gaaaaaatggcgtgccttgtg

SEQ ID NO: 19412 - DNA, 32 bp, Homo sapiens
ttaaaattgcatcttgaccaggcacagtggct

SEQ ID NO: 19413 - DNA, 32 bp, Homo sapiens
gacacaagagcctcacatgagaaattaccagt

SEQ ID NO: 19414 - DNA, 32 bp, Homo sapiens
agaagaggagcaggagaaacaaatcgttaaaa

SEQ ID NO: 19415 - DNA, 32 bp, Homo sapiens
taaatgaggacttggcttatgaccagtctgat

SEQ ID NO: 19416 - DNA, 32 bp, Homo sapiens
gtaatttgcccagctgctaactgtgaagcaaa

SEQ ID NO: 19417 - DNA, 32 bp, Homo sapiens
cagtgtgggcctgggctctcttgggctttatc

SEQ ID NO: 19418 - DNA, 32 bp, Homo sapiens
gctctgttgcccaggctggaatgcagtggcac

SEQ ID NO: 19419 - DNA, 32 bp, Homo sapiens
gctctgtcgcccaggctggagtgcagtgacat

SEQ ID NO: 19420 - DNA, 32 bp, Homo sapiens
tggaggatcttaaagagaccagttacagatgc

SEQ ID NO: 19421 - DNA, 32 bp, Homo sapiens
gtatctggtaggggagaaagcagcaggacagt

SEQ ID NO: 19422 - DNA, 32 bp, Homo sapiens
gagcctgggaggtggaggttgccagtgagtcg

SEQ ID NO: 19423 - DNA, 23 bp, Homo sapiens
gacacacactggaggcaaaccct

SEQ ID NO: 19424 - DNA, 32 bp, Homo sapiens
aggtcccattttccccctgtgttttcacgcag

SEQ ID NO: 19425 - DNA, 25 bp, Homo sapiens
caggaatgctgccttccttcagccc

SEQ ID NO: 19426 - DNA, 32 bp, Homo sapiens
gctctgtcacccaggctggagtgcagtggtgt

SEQ ID NO: 19427 - DNA, 32 bp, Homo sapiens
gctctgtcacccaggctggagtgtagtggtgc

SEQ ID NO: 19428 - DNA, 32 bp, Homo sapiens
actctgttgcccaggatggagtgcagtggtga

SEQ ID NO: 19429 - DNA, 32 bp, Homo sapiens
actctgttgcccaggctggagtgcagtggtgc

SEQ ID NO: 19430 - DNA, 32 bp, Homo sapiens
gctctgttgcccaggctggagtgcggtggtgc

SEQ ID NO: 19431 - DNA, 32 bp, Homo sapiens
actctgttgcccaggctggagtgtagtggtgt

SEQ ID NO: 19432 - DNA, 21 bp, Homo sapiens
ctgtctcccaggctggagtgc

SEQ ID NO: 19433 - DNA, 32 bp, Homo sapiens
cgcctgcgcctccatccatctgtccgtccaga

SEQ ID NO: 19434 - DNA, 32 bp, Homo sapiens
actctgtcgcccaggctggagtgcagtggtgt

SEQ ID NO: 19435 - DNA, 32 bp, Homo sapiens
tggggttcaagtgatcctcccacctcagcctc

SEQ ID NO: 19436 - DNA, 32 bp, Homo sapiens
ctgagctcaagcaaccctccctcctcagcctt

SEQ ID NO: 19437 - DNA, 32 bp, Homo sapiens
gtcagggcttctgggttcccttaactttgtgc

SEQ ID NO: 19438 - DNA, 32 bp, Homo sapiens
cccttgtcacccacgcagaggcagtgtcatga

SEQ ID NO: 19439 - DNA, 32 bp, Homo sapiens
actaagacagactgtagatgcattttaaatat

SEQ ID NO: 19440 - DNA, 20 bp, Homo sapiens
gggtggctggggtaggggct

SEQ ID NO: 19441 - DNA, 32 bp, Homo sapiens
cacaatcatcttctcccaagactgctcccttt

SEQ ID NO: 19442 - DNA, 32 bp, Homo sapiens
gcaggatatcttctcccccagggatcttctat

SEQ ID NO: 19443 - DNA, 32 bp, Homo sapiens
gggcagccctggaggagccactgtgggctcca

SEQ ID NO: 19444 - DNA, 32 bp, Homo sapiens
cctaatgatccctcgcagagctcagactaagt

SEQ ID NO: 19445 - DNA, 32 bp, Homo sapiens
aaataccctaacctttaactgtcttgaattat

SEQ ID NO: 19446 - DNA, 32 bp, Homo sapiens
ctctgtcgcccaggctggagtgcagtcgtgcc

SEQ ID NO: 19447 - DNA, 32 bp, Homo sapiens
aaatctgtctcaggctggtagttagcagttgt

SEQ ID NO: 19448 - DNA, 32 bp, Homo sapiens
gacgcgagggcttggcttttctcgtcagctgc

SEQ ID NO: 19449 - DNA, 28 bp, Homo sapiens
gttgggcctaatcctgcctcatcattct

SEQ ID NO: 19450 - DNA, 32 bp, Homo sapiens
gacccacgtgctccagtcccagctccaaaagc

SEQ ID NO: 19451 - DNA, 32 bp, Homo sapiens
ccactcgggaggctgaggcaagagagttactt

SEQ ID NO: 19452 - DNA, 32 bp, Homo sapiens
gaaccccagaggtggaggttgcagtgagccga

SEQ ID NO: 19453 - DNA, 32 bp, Homo sapiens
ggaccactacctgcagctaagcagtgagcaga

SEQ ID NO: 19454 - DNA, 32 bp, Homo sapiens
tgttttagaagaggcagaacagtgataaagac

SEQ ID NO: 19455 - DNA, 32 bp, Homo sapiens
cctggaggaagaggaggaggaggaggaggaag

SEQ ID NO: 19456 - DNA, 32 bp, Homo sapiens
aagggagccccaggctggagcagcatgaggcc

SEQ ID NO: 19457 - DNA, 32 bp, Homo sapiens
actctgttgccctggctggagtgcagtagagt

SEQ ID NO: 19458 - DNA, 32 bp, Homo sapiens
tgactggcctgagactctataccgggagtctc

SEQ ID NO: 19459 - DNA, 32 bp, Homo sapiens
gggccaggagcttgaaggaactgtgaaataaa

SEQ ID NO: 19460 - DNA, 24 bp, Homo sapiens
tcacgcctgtaaccccatcacttt

SEQ ID NO: 19461 - DNA, 32 bp, Homo sapiens
caagtggggaggcaggtgacagggactccgag

SEQ ID NO: 19462 - DNA, 32 bp, Homo sapiens
ctctgtcacccaggctgtagtacagtggtgcc

SEQ ID NO: 19463 - DNA, 32 bp, Homo sapiens
ctgcaagctgaggaagaaagaagccaatagta

SEQ ID NO: 19464 - DNA, 32 bp, Homo sapiens
atagaatacagcatggaaaatatcagtgtatt

SEQ ID NO: 19465 - DNA, 32 bp, Homo sapiens
tgagatggtgacaggctggcctgcagtcagca

SEQ ID NO: 19466 - DNA, 32 bp, Homo sapiens
cccgacaggccagaggaatcagtttagacttg

SEQ ID NO: 19467 - DNA, 32 bp, Homo sapiens
ctctgtcgtccaggttagagtgcaatggcttg

SEQ ID NO: 19468 - DNA, 32 bp, Homo sapiens
ggattgtgctgactttgggattaacatgagct

SEQ ID NO: 19469 - DNA, 32 bp, Homo sapiens
acccaagggtcaacaggagactctctgctgag

SEQ ID NO: 19470 - DNA, 32 bp, Homo sapiens
atgatgaaagagacaatgtaatactgttggtc

SEQ ID NO: 19471 - DNA, 28 bp, Homo sapiens
gaccagatgtgtcctgcctcatccctag

SEQ ID NO: 19472 - DNA, 19 bp, Homo sapiens
cttgtaatcccagcacttt

SEQ ID NO: 19473 - DNA, 21 bp, Homo sapiens
atcctcctgtcccctctggga

SEQ ID NO: 19474 - DNA, 28 bp, Homo sapiens
tgatgagtgactcctgcctcatccattg

SEQ ID NO: 19475 - DNA, 32 bp, Homo sapiens
caagtcaacctctctgttcaggcacagatctg

SEQ ID NO: 19476 - DNA, 32 bp, Homo sapiens
tctggccaacaaacatgagccacttttcccag

SEQ ID NO: 19477 - DNA, 23 bp, Homo sapiens
tcacgcctgtaatcccagacttt

SEQ ID NO: 19478 - DNA, 32 bp, Homo sapiens
atctccatgccagcagggtgccttttatatca

SEQ ID NO: 19479 - DNA, 16 bp, Homo sapiens
gcacgtggctcactgc

SEQ ID NO: 19480 - DNA, 32 bp, Homo sapiens
cctgctgtgctgctgccatggcgcatgctcct

SEQ ID NO: 19481 - DNA, 32 bp, Homo sapiens
ccttacgaggagacttggtcactgtgaaggag

SEQ ID NO: 19482 - DNA, 32 bp, Homo sapiens
gctctgttgccctggctggagtacagtggcat

SEQ ID NO: 19483 - DNA, 32 bp, Homo sapiens
agaatgttcttttggccactgtgaagcctcag

SEQ ID NO: 19484 - DNA, 32 bp, Homo sapiens
ggcctccctagtagctgggattacaggcgcac

SEQ ID NO: 19485 - DNA, 32 bp, Homo sapiens
cacctcctgagtagctgggactacagttgtgc

SEQ ID NO: 19486 - DNA, 32 bp, Homo sapiens
attattgaagcgatttctatgtggaaataaat

SEQ ID NO: 19487 - DNA, 32 bp, Homo sapiens
gtgaccgcaagcgattcacccacctcagcctc

SEQ ID NO: 19488 - DNA, 32 bp, Homo sapiens
cagaactcttctctccccatcatgggccacag

SEQ ID NO: 19489 - DNA, 32 bp, Homo sapiens
agtggggagagacggcaggtgcagtgatggct

SEQ ID NO: 19490 - DNA, 32 bp, Homo sapiens
ttgcttcaggccgacttcctaaggaaggcatg

SEQ ID NO: 19491 - DNA, 32 bp, Homo sapiens
cagctctaggaacttagtactttggagctttt

SEQ ID NO: 19492 - DNA, 18 bp, Homo sapiens
gcaaattgaatgctctct

SEQ ID NO: 19493 - DNA, 21 bp, Homo sapiens
gattctcgctccttcatttca

SEQ ID NO: 19494 - DNA, 32 bp, Homo sapiens
cctctgtcaaccaggctggagtgcagtgactc

SEQ ID NO: 19495 - DNA, 32 bp, Homo sapiens
accacggtgtttccccttatctctaccatggc

SEQ ID NO: 19496 - DNA, 32 bp, Homo sapiens
gtgattggctagtgattcttgttttcagaagg

SEQ ID NO: 19497 - DNA, 32 bp, Homo sapiens
gaacccgggaggaggagcttgcagtgagccga

SEQ ID NO: 19498 - DNA, 32 bp, Homo sapiens
aaaatcaggtggaccttcctggacatatcctg

SEQ ID NO: 19499 - DNA, 32 bp, Homo sapiens
gaacccaaaaggcagacattgcagtgagccaa

SEQ ID NO: 19500 - DNA, 32 bp, Homo sapiens
gaacctgtgggtcagaggttgcagtgaaccaa

SEQ ID NO: 19501 - DNA, 32 bp, Homo sapiens
taacccggaaggtggagtttgcagtgagccga

SEQ ID NO: 19502 - DNA, 32 bp, Homo sapiens
atgagggagagaggagagaggagaggaaaggg

SEQ ID NO: 19503 - DNA, 32 bp, Homo sapiens
ccatggccagcaggaagccactgatgagggga

SEQ ID NO: 19504 - DNA, 22 bp, Homo sapiens
gcactgtctcggctcactgcag

SEQ ID NO: 19505 - DNA, 32 bp, Homo sapiens
gttttgcagcccaggctggagtgcagtggcac

SEQ ID NO: 19506 - DNA, 32 bp, Homo sapiens
ctcttgttgatgaggctggagtgcagtggcgc

SEQ ID NO: 19507 - DNA, 32 bp, Homo sapiens
tctaaagccccaggctgggttaggtggtctag

SEQ ID NO: 19508 - DNA, 28 bp, Homo sapiens
tgcaactcaggggtggcctcatcctccc

SEQ ID NO: 19509 - DNA, 20 bp, Homo sapiens
gggccagctcgctccaggga

SEQ ID NO: 19510 - DNA, 32 bp, Homo sapiens
gaaccctggaggtggaggttgcagtgagctga

SEQ ID NO: 19511 - DNA, 32 bp, Homo sapiens
ggtactctgcctctctgctccctgggggccaa

SEQ ID NO: 19512 - DNA, 32 bp, Homo sapiens
tcggcaggagcctctcaatggagtccacttcc

SEQ ID NO: 19513 - DNA, 32 bp, Homo sapiens
aaatatatcaaaacatgtaaacgcccacctta

SEQ ID NO: 19514 - DNA, 32 bp, Homo sapiens
ccttcctcaccgcagatgtttctgcctcttaa

SEQ ID NO: 19515 - DNA, 32 bp, Homo sapiens
agcctcctgagtagctggaattacaggaggat

SEQ ID NO: 19516 - DNA, 32 bp, Homo sapiens
gcacacagaaaacaggctctgccttcacatgt

SEQ ID NO: 19517 - DNA, 32 bp, Homo sapiens
acgcaggagctgctgctgcagttgcagaagga

SEQ ID NO: 19518 - DNA, 32 bp, Homo sapiens
atggatcaagacggttacctggcacgctggcc

SEQ ID NO: 19519 - DNA, 32 bp, Homo sapiens
ctaccttcacttctccccagctctgccctctg

SEQ ID NO: 19520 - DNA, 24 bp, Homo sapiens
agtgaggaagtgactgtatgtgga

SEQ ID NO: 19521 - DNA, 32 bp, Homo sapiens
ctttccagaagaggagacaaaagcaagatagc

SEQ ID NO: 19522 - DNA, 32 bp, Homo sapiens
cctttgtagtccttcagccactgtgggccctg

SEQ ID NO: 19523 - DNA, 32 bp, Homo sapiens
tgaagttttgcagaaattgactgtgaaatgtc

SEQ ID NO: 19524 - DNA, 32 bp, Homo sapiens
agggctcatccctctgcagagcgcggggtcac

SEQ ID NO: 19525 - DNA, 32 bp, Homo sapiens
gggggttggcctgggagcctcctccgcttccc

SEQ ID NO: 19526 - DNA, 32 bp, Homo sapiens
ggacaggacttccttccatcttctcctgctca

SEQ ID NO: 19527 - DNA, 32 bp, Homo sapiens
gttctgtctcccaggctgaagtgcagtgagtc

SEQ ID NO: 19528 - DNA, 32 bp, Homo sapiens
ctgggttcaagcaattctccagcctcagcctc

SEQ ID NO: 19529 - DNA, 32 bp, Homo sapiens
gtagaatgggctcatgggcaatgtgatgttcc

SEQ ID NO: 19530 - DNA, 32 bp, Homo sapiens
gcctaatttaccaaggatgaattctttcaatt

SEQ ID NO: 19531 - DNA, 32 bp, Homo sapiens
gtccgccccaaaacccggccttggtccctggc

SEQ ID NO: 19532 - DNA, 28 bp, Homo sapiens
gggcacccaagtgccccctgtctgcgaa

SEQ ID NO: 19533 - DNA, 32 bp, Homo sapiens
ctctgtctcccagactggagtgagtggtgtga

SEQ ID NO: 19534 - DNA, 32 bp, Homo sapiens
ggtcatcatccctacccacacacagatggcca

SEQ ID NO: 19535 - DNA, 32 bp, Homo sapiens
acccgcggcgcaggagcttcagtggtctgggg

SEQ ID NO: 19536 - DNA, 32 bp, Homo sapiens
ctatgttgcccaggctggagtgcagtggtgcg

SEQ ID NO: 19537 - DNA, 32 bp, Homo sapiens
ctctgttgcccaggttggagtacagcagtgcc

SEQ ID NO: 19538 - DNA, 32 bp, Homo sapiens
ctctgtcgccaaggctggagtgcagtggtgtg

SEQ ID NO: 19539 - DNA, 32 bp, Homo sapiens
gcgtccacacccagacgggtccagtccagccc

SEQ ID NO: 19540 - DNA, 31 bp, Homo sapiens
cttgcaacacaagaccctaggagggaggacg

SEQ ID NO: 19541 - DNA, 32 bp, Homo sapiens
gtccccgggaggcagctggggcagcagcagtg

SEQ ID NO: 19542 - DNA, 32 bp, Homo sapiens
gccccctggaggcagagcactgagctggaccc

SEQ ID NO: 19543 - DNA, 32 bp, Homo sapiens
tcttatttctgaggcccttcagtctcctttat

SEQ ID NO: 19544 - DNA, 32 bp, Homo sapiens
ccttctttacctctgagctttctgccttctga

SEQ ID NO: 19545 - DNA, 32 bp, Homo sapiens
ataggagtgatctcaagtgagatagcagagca

SEQ ID NO: 19546 - DNA, 25 bp, Homo sapiens
acaggcgtgagccaccacgcccggc

SEQ ID NO: 19547 - DNA, 25 bp, Homo sapiens
acaggcatgagccaccacgcccagc

SEQ ID NO: 19548 - DNA, 32 bp, Homo sapiens
gtatgcagaggagttttcaagaggctatctgg

SEQ ID NO: 19549 - DNA, 32 bp, Homo sapiens
ctttgttgcccagactggagggcagtggcgcg

SEQ ID NO: 19550 - DNA, 32 bp, Homo sapiens
ctctgtcgcccaggctggagtgcagtggtggc

SEQ ID NO: 19551 - DNA, 32 bp, Homo sapiens
atttaaaagctattattcttagcattaaccta

SEQ ID NO: 19552 - DNA, 32 bp, Homo sapiens
tctctgtcatccaggctagagtgcagtggcac

SEQ ID NO: 19553 - DNA, 32 bp, Homo sapiens
taaggaaggaaggaggaatgaggctggatacg

SEQ ID NO: 19554 - DNA, 32 bp, Homo sapiens
ctctgttgcccaggctggagttcagcggtgca

SEQ ID NO: 19555 - DNA, 32 bp, Homo sapiens
agcctcctgagtacctgggattacaggcgcgc

SEQ ID NO: 19556 - DNA, 32 bp, Homo sapiens
ttctgttgcccaggcaagagtgcagtggtatg

SEQ ID NO: 19557 - DNA, 32 bp, Homo sapiens
tgtcctgtcatctagccatctgatatcttcct

SEQ ID NO: 19558 - DNA, 32 bp, Homo sapiens
agcctcctgagtatctgggattacaggcgtgc

SEQ ID NO: 19559 - DNA, 32 bp, Homo sapiens
agcctcctgagtagctgggatgacaggcgtgc

SEQ ID NO: 19560 - DNA, 32 bp, Homo sapiens
agcctccagagtagctgggattttaggtgtgc

SEQ ID NO: 19561 - DNA, 32 bp, Homo sapiens
tcctgccatccacactatgagcattttgaaat

SEQ ID NO: 19562 - DNA, 32 bp, Homo sapiens
ttcatgtacctgcacatgtgacctttgtgaac

SEQ ID NO: 19563 - DNA, 23 bp, Homo sapiens
tgtaacccaggctggaatgcaat

SEQ ID NO: 19564 - DNA, 32 bp, Homo sapiens
gccgctcgggacgacttcctcggctgcgcggc

SEQ ID NO: 19565 - DNA, 32 bp, Homo sapiens
ccagattcaagcaactctctgcctcagcctcc

SEQ ID NO: 19566 - DNA, 32 bp, Homo sapiens
ggccggcagccctgggctgaggcacagactca

SEQ ID NO: 19567 - DNA, 32 bp, Homo sapiens
agagattctaaaacatgttcagcactttctgg

SEQ ID NO: 19568 - DNA, 32 bp, Homo sapiens
tttatgcctgctgcttctctgcctctttgagg

SEQ ID NO: 19569 - DNA, 32 bp, Homo sapiens
tagtgtcacccaggctggagtgcagtgatcca

SEQ ID NO: 19570 - DNA, 20 bp, Homo sapiens
ccactcccggcctgacacca

SEQ ID NO: 19571 - DNA, 32 bp, Homo sapiens
cagctgagcctagaggtgaatttcgttgggga

SEQ ID NO: 19572 - DNA, 32 bp, Homo sapiens
ctttgtcgcccaggccggagtgcagtggtgcg

SEQ ID NO: 19573 - DNA, 32 bp, Homo sapiens
ccctgttgcccatgctggagtgcaatggcacg

SEQ ID NO: 19574 - DNA, 32 bp, Homo sapiens
gacagttattgacactgatgtgcaatgaagtg

SEQ ID NO: 19575 - DNA, 32 bp, Homo sapiens
ttcctcccaaagtgctgggattaatggcgtga

SEQ ID NO: 19576 - DNA, 32 bp, Homo sapiens
ctctatcgcccaggctggagtgcagtggcgca

SEQ ID NO: 19577 - DNA, 32 bp, Homo sapiens
ccagaagaagagacctgcaactgtgagagtcc

SEQ ID NO: 19578 - DNA, 32 bp, Homo sapiens
ttgtttttaggcaattctggctggcctgagaa

SEQ ID NO: 19579 - DNA, 32 bp, Homo sapiens
ccccgggaccgtgttgctccagtattaacctc

SEQ ID NO: 19580 - DNA, 18 bp, Homo sapiens
cccaggctggagtgcaat

SEQ ID NO: 19581 - DNA, 32 bp, Homo sapiens
tattttccaagtgccttcaccaaaaggccaag

SEQ ID NO: 19582 - DNA, 32 bp, Homo sapiens
ttgatagcaaacactgggggcaccttaagatt

SEQ ID NO: 19583 - DNA, 27 bp, Homo sapiens
agatgcaggaggcagatatcagtggct

SEQ ID NO: 19584 - DNA, 32 bp, Homo sapiens
gaacctgggaggcagagtttgcagtgagccga

SEQ ID NO: 19585 - DNA, 32 bp, Homo sapiens
ccgcttcaacatcagctgcctctgctatgacc

SEQ ID NO: 19586 - DNA, 32 bp, Homo sapiens
accctcacaccgctgctcctctggacctctgt

SEQ ID NO: 19587 - DNA, 20 bp, Homo sapiens
catgggaatcccagcactcc

SEQ ID NO: 19588 - DNA, 32 bp, Homo sapiens
ggctgcgggaggcgggggttggcgtgcctgag

SEQ ID NO: 19589 - DNA, 32 bp, Homo sapiens
agggagcagctttctatcctggccacactgag

SEQ ID NO: 19590 - DNA, 32 bp, Homo sapiens
ccctggcagctttcttcaagagacttgcataa

SEQ ID NO: 19591 - DNA, 32 bp, Homo sapiens
atccactttgcagcttctttgagattacctat

SEQ ID NO: 19592 - DNA, 32 bp, Homo sapiens
cttggtgctgaacttagccacaaggagctgtc

SEQ ID NO: 19593 - DNA, 23 bp, Homo sapiens
tggcacagtctcggctcactgca

SEQ ID NO: 19594 - DNA, 32 bp, Homo sapiens
cctgagccccaggtctcttcagtctgggcaca

SEQ ID NO: 19595 - DNA, 32 bp, Homo sapiens
gctctgtcattcaggctggagtgcagtggtgc

SEQ ID NO: 19596 - DNA, 32 bp, Homo sapiens
gaggaaatgagagaggaatgctcttgaaaggt

SEQ ID NO: 19597 - DNA, 32 bp, Homo sapiens
tggaagccttcaggttgctgtgcaatggaata

SEQ ID NO: 19598 - DNA, 32 bp, Homo sapiens
cttcctgggctgacctgctccctcgaggccag

SEQ ID NO: 19599 - DNA, 32 bp, Homo sapiens
gcccacctccaggcctctcccacctcaggccc

SEQ ID NO: 19600 - DNA, 32 bp, Homo sapiens
ctcccgcatccctcgcctgcacagtgggcagt

SEQ ID NO: 19601 - DNA, 32 bp, Homo sapiens
cctgagccgggaaccatctcccaggaccttgc

SEQ ID NO: 19602 - DNA, 32 bp, Homo sapiens
ctacttcctcaaggttctttctgtccagttgc

SEQ ID NO: 19603 - DNA, 32 bp, Homo sapiens
agagggacgtggggagaaagaagccagaagcc

SEQ ID NO: 19604 - DNA, 32 bp, Homo sapiens
ccacagccagttctgcatcaccacacacagcc

SEQ ID NO: 19605 - DNA, 24 bp, Homo sapiens
gaagagtacctggtgaaccctgtg

SEQ ID NO: 19606 - DNA, 32 bp, Homo sapiens
gggcatagagtgagtggatgtgatgggctgtg

SEQ ID NO: 19607 - DNA, 32 bp, Homo sapiens
ttatatgtctccattctttttaaaatcttaac

SEQ ID NO: 19608 - DNA, 29 bp, Homo sapiens
aaggatgcctccattcctgcttctcacct

SEQ ID NO: 19609 - DNA, 32 bp, Homo sapiens
ctgggctcaagcagtcctcccaccccagcctc

SEQ ID NO: 19610 - DNA, 32 bp, Homo sapiens
ttaagggaacccagaagtgaattcttttgtaa

SEQ ID NO: 19611 - DNA, 32 bp, Homo sapiens
aggctcctgagtagctgggactacaggattac

SEQ ID NO: 19612 - DNA, 28 bp, Homo sapiens
acagtgcctagtgctgctcattatgtgt

SEQ ID NO: 19613 - DNA, 32 bp, Homo sapiens
tggctgggaaagagggatgtgcagtgacgtgg

SEQ ID NO: 19614 - DNA, 32 bp, Homo sapiens
gatggaaggaagactgggttgcagggactgtg

SEQ ID NO: 19615 - DNA, 32 bp, Homo sapiens
ggctgggtctgtaggttgttgcagtgaacgac

SEQ ID NO: 19616 - DNA, 32 bp, Homo sapiens
ccccacttctctctccccatccccacccagtc

SEQ ID NO: 19617 - DNA, 32 bp, Homo sapiens
ttaatagcattgggatatagtcactgtaatgg

SEQ ID NO: 19618 - DNA, 22 bp, Homo sapiens
catgcctataatcccggctact

SEQ ID NO: 19619 - DNA, 32 bp, Homo sapiens
tcctggccagaacttgagccagctgtgggatg

SEQ ID NO: 19620 - DNA, 32 bp, Homo sapiens
gaagccagcctatcacctggctgggtgagaag

SEQ ID NO: 19621 - DNA, 32 bp, Homo sapiens
tcttcctgcagaggctcctttctgcctccatg

SEQ ID NO: 19622 - DNA, 32 bp, Homo sapiens
tagagaatgtggcttcaactgggcttattaaa

SEQ ID NO: 19623 - DNA, 32 bp, Homo sapiens
gctctgttgcccatgctggagtgcattggcac

SEQ ID NO: 19624 - DNA, 32 bp, Homo sapiens
taatagtgcaggaagggatgagcttttgattt

SEQ ID NO: 19625 - DNA, 32 bp, Homo sapiens
accttggcctcccgtgttcaagcgattctcct

SEQ ID NO: 19626 - DNA, 32 bp, Homo sapiens
tccaggcccagctgcagcaacaacagtcatta

SEQ ID NO: 19627 - DNA, 32 bp, Homo sapiens
cgcccgctgctgctgctcgcttacttcagtcg

SEQ ID NO: 19628 - DNA, 20 bp, Homo sapiens
gggcgctcggaccaggcagc

SEQ ID NO: 19629 - DNA, 32 bp, Homo sapiens
gggacacgtagaggagagaaaagcgaccaaga

SEQ ID NO: 19630 - DNA, 32 bp, Homo sapiens
ggagagagcctacctagacagtgcagtcctgc

SEQ ID NO: 19631 - DNA, 21 bp, Homo sapiens
ctgaccaacatggtgaaactc

SEQ ID NO: 19632 - DNA, 21 bp, Homo sapiens
gcacgatcttggctcactgca

SEQ ID NO: 19633 - DNA, 32 bp, Homo sapiens
gtgtatggatgaggctggagtgatctgggacc

SEQ ID NO: 19634 - DNA, 32 bp, Homo sapiens
tgaccaaaagagaccttgttttctttgagaag

SEQ ID NO: 19635 - DNA, 32 bp, Homo sapiens
aacggggtccccggactggagaagacgcgggt

SEQ ID NO: 19636 - DNA, 32 bp, Homo sapiens
gcctcaaactcctgggctcaagcaatcctcct

SEQ ID NO: 19637 - DNA, 32 bp, Homo sapiens
ccccatgggaggcacattagctagtggcaagt

SEQ ID NO: 19638 - DNA, 32 bp, Homo sapiens
ggaatgaggctggatacggtgcagtgaaaaag

SEQ ID NO: 19639 - DNA, 32 bp, Homo sapiens
tgattttcaaacccatatgcttctaaccacta

SEQ ID NO: 19640 - DNA, 22 bp, Homo sapiens
cgcccccgccccggccccgaga

SEQ ID NO: 19641 - DNA, 32 bp, Homo sapiens
gtagaagaaggcagttagagaaaacaaagtat

SEQ ID NO: 19642 - DNA, 32 bp, Homo sapiens
ttttcacccagagagtgaagatcatggaggag

SEQ ID NO: 19643 - DNA, 32 bp, Homo sapiens
gctctgttgcccaggctggagtgcagtggtga

SEQ ID NO: 19644 - DNA, 32 bp, Homo sapiens
aaagaactgcctgaattactgcaatgaaatag

SEQ ID NO: 19645 - DNA, 32 bp, Homo sapiens
gatggtcttgttctgtcaaccaggctagaatg

SEQ ID NO: 19646 - DNA, 19 bp, Homo sapiens
cctgtagtcccagcacttt

SEQ ID NO: 19647 - DNA, 22 bp, Homo sapiens
tcacacctgtaaccccagcact

SEQ ID NO: 19648 - DNA, 32 bp, Homo sapiens
gggaggctgaggcagaattgcttgaacccagg

SEQ ID NO: 19649 - DNA, 23 bp, Homo sapiens
tgtcactcaggctggagtgcagt

SEQ ID NO: 19650 - DNA, 19 bp, Homo sapiens
gcgaggagtccccggggag

SEQ ID NO: 19651 - DNA, 17 bp, Homo sapiens
gcctcatcctgtccagg

SEQ ID NO: 19652 - DNA, 32 bp, Homo sapiens
ggagtacaatggtgcgatctttgctcactgca

SEQ ID NO: 19653 - DNA, 32 bp, Homo sapiens
tggactgccctctccttcttggtgattcaaag

SEQ ID NO: 19654 - DNA, 20 bp, Homo sapiens
aaagaagaaactttgcctca

SEQ ID NO: 19655 - DNA, 32 bp, Homo sapiens
gagtgcctactctggcttgagcacttctatat

SEQ ID NO: 19656 - DNA, 32 bp, Homo sapiens
agatgttcactcagactgggggatgcaatgtg

SEQ ID NO: 19657 - DNA, 32 bp, Homo sapiens
ccggcctaaccaggctggagtgcagtggtggg

SEQ ID NO: 19658 - DNA, 32 bp, Homo sapiens
aagtgtaccttcacctgctccagtgatgagag

SEQ ID NO: 19659 - DNA, 32 bp, Homo sapiens
agaagaggaggaggagaaagaagcagcaacga

SEQ ID NO: 19660 - DNA, 32 bp, Homo sapiens
ttgcccttaaaccatttctagctgttaaccct

SEQ ID NO: 19661 - DNA, 32 bp, Homo sapiens
cttgtgcaacatcaaggagaagctgcggaaat

SEQ ID NO: 19662 - DNA, 32 bp, Homo sapiens
ggaaattagctttcaatttagtatacggaaag

SEQ ID NO: 19663 - DNA, 32 bp, Homo sapiens
ctcaatcatcttctcctggccaaggctctgac

SEQ ID NO: 19664 - DNA, 32 bp, Homo sapiens
taggatatgagggttaggcctttgccacatta

SEQ ID NO: 19665 - DNA, 32 bp, Homo sapiens
acctggtgcccaggtggaggtgcagtgggggt

SEQ ID NO: 19666 - DNA, 32 bp, Homo sapiens
ctaatcctacctgatctttaacaaagcattaa

SEQ ID NO: 19667 - DNA, 32 bp, Homo sapiens
gaaggaggaagaggaggaggaggaagagggga

SEQ ID NO: 19668 - DNA, 32 bp, Homo sapiens
ctgggctcaagcaatctgccagcctcagcctc

SEQ ID NO: 19669 - DNA, 32 bp, Homo sapiens
agcctccccgagtgctgggattaaagacgtga

SEQ ID NO: 19670 - DNA, 32 bp, Homo sapiens
tcttgttgcccaacctggagtgcagtggtgcg

SEQ ID NO: 19671 - DNA, 32 bp, Homo sapiens
cagctgcaggaaggctctgacaacagcccgcc

SEQ ID NO: 19672 - DNA, 32 bp, Homo sapiens
tcttctcagggcactgcactggaacactgggt

SEQ ID NO: 19673 - DNA, 32 bp, Homo sapiens
cctccaccttcctggttcaagcgattctgcct

SEQ ID NO: 19674 - DNA, 32 bp, Homo sapiens
gctctgtcactcaggctggagtacagtggcac

SEQ ID NO: 19675 - DNA, 32 bp, Homo sapiens
gtgtgatggggttttgctcttgttgcccaggc

SEQ ID NO: 19676 - DNA, 32 bp, Homo sapiens
atctttagcagtttcctcagtgatggaatatc

SEQ ID NO: 19677 - DNA, 32 bp, Homo sapiens
cagggctcaagggatcctcccacctcagcctc

SEQ ID NO: 19678 - DNA, 32 bp, Homo sapiens
agcctcccgagtagctgggattacaggtgtgg

SEQ ID NO: 19679 - DNA, 32 bp, Homo sapiens
ctcttgttgcccaggctgaagtgcagtgttgt

SEQ ID NO: 19680 - DNA, 32 bp, Homo sapiens
ctcttgtcgcccaggctggagtgcaatggcgc

SEQ ID NO: 19681 - DNA, 32 bp, Homo sapiens
gcttctaccgagtcttcccccacctcaatccc

SEQ ID NO: 19682 - DNA, 16 bp, Homo sapiens
cctctgcccccaggta

SEQ ID NO: 19683 - DNA, 32 bp, Homo sapiens
gcttgcgggaggcggtggggcatgggaggaag

SEQ ID NO: 19684 - DNA, 28 bp, Homo sapiens
ccccaggcagctgctgcctccactatcg

SEQ ID NO: 19685 - DNA, 20 bp, Homo sapiens
gccacactggctacccagaa

SEQ ID NO: 19686 - DNA, 24 bp, Homo sapiens
ctgtctcgcaggccagagtgcagt

SEQ ID NO: 19687 - DNA, 32 bp, Homo sapiens
atgtgctattggagaacaggtctttgtggaga

SEQ ID NO: 19688 - DNA, 32 bp, Homo sapiens
ctcttgttgcccaggctggagtacaatggcat

SEQ ID NO: 19689 - DNA, 32 bp, Homo sapiens
agctggaggcccgggctggaggggcagtgttg

SEQ ID NO: 19690 - DNA, 32 bp, Homo sapiens
gcccagcgccccgcctggagtggatgagcctc

SEQ ID NO: 19691 - DNA, 32 bp, Homo sapiens
ttcccaattaggaattcaatgtggaaaacata

SEQ ID NO: 19692 - DNA, 32 bp, Homo sapiens
ctctctcgccatggttggagtgcagtggtgcg

SEQ ID NO: 19693 - DNA, 32 bp, Homo sapiens
ctcttgttgcccaggctggagtgcaatggcgt

SEQ ID NO: 19694 - DNA, 24 bp, Homo sapiens
tcatgcctgtaatctcagaacttt

SEQ ID NO: 19695 - DNA, 32 bp, Homo sapiens
gaaccctggaggtggcggttgcagtgagcaca

SEQ ID NO: 19696 - DNA, 32 bp, Homo sapiens
ttgaccgggagacagaggttgcagtgagctga

SEQ ID NO: 19697 - DNA, 32 bp, Homo sapiens
aactcagagccagcttgtggcaagcagttggg

SEQ ID NO: 19698 - DNA, 21 bp, Homo sapiens
tgatcttgccattgcactcca

SEQ ID NO: 19699 - DNA, 18 bp, Homo sapiens
cctgtaatcccacacttt

SEQ ID NO: 19700 - DNA, 21 bp, Homo sapiens
cagggagcccaaacacccagc

SEQ ID NO: 19701 - DNA, 32 bp, Homo sapiens
ccagcaagcatttctgccctagctaattctcc

SEQ ID NO: 19702 - DNA, 32 bp, Homo sapiens
ttgagaaggcgtttcgctcttgttgcccaggc

SEQ ID NO: 19703 - DNA, 32 bp, Homo sapiens
tctttttgcccaggctggagtgcagtggcgcc

SEQ ID NO: 19704 - DNA, 32 bp, Homo sapiens
cctcaactcattctgtcaccagtagaattcag

SEQ ID NO: 19705 - DNA, 32 bp, Homo sapiens
gatgagttctggcagtctgtgttttcatttga

SEQ ID NO: 19706 - DNA, 32 bp, Homo sapiens
ccggattcaagcaattcttctgcctcagcttc

SEQ ID NO: 19707 - DNA, 32 bp, Homo sapiens
tatttgagtgtacaaacccatggctgggctca

SEQ ID NO: 19708 - DNA, 32 bp, Homo sapiens
aataaagtgttctattaacctgatctctttgc

SEQ ID NO: 19709 - DNA, 32 bp, Homo sapiens
ctccctctcaggcagagaggttgccgagtgat

SEQ ID NO: 19710 - DNA, 32 bp, Homo sapiens
gaacccgggaggcggatgttgcggtgagccga

SEQ ID NO: 19711 - DNA, 32 bp, Homo sapiens
tatagagattgatttcaagggagttacattat

SEQ ID NO: 19712 - DNA, 32 bp, Homo sapiens
gttagagccctctttctccccgaagaaagagc

SEQ ID NO: 19713 - DNA, 23 bp, Homo sapiens
ccttgacacttttgaacatttcc

SEQ ID NO: 19714 - DNA, 32 bp, Homo sapiens
ctgtcgcctgcagctgctcgcctgtctccgtc

SEQ ID NO: 19715 - DNA, 32 bp, Homo sapiens
gaggcagcgtggactggtgactgtgaaggaag

SEQ ID NO: 19716 - DNA, 32 bp, Homo sapiens
ctgtagctgctgctgctggctccactcctgcg

SEQ ID NO: 19717 - DNA, 32 bp, Homo sapiens
ctgcggtgtctgctgctactctccgagcttcg

SEQ ID NO: 19718 - DNA, 32 bp, Homo sapiens
tcttattgcccaggctggagtgcaatggtgca

SEQ ID NO: 19719 - DNA, 32 bp, Homo sapiens
gaacgctatttcctaaatatttgctacacaca

SEQ ID NO: 19720 - DNA, 24 bp, Homo sapiens
ctggggaacataatgagacccatc

SEQ ID NO: 19721 - DNA, 32 bp, Homo sapiens
ctgacctcaggtgatctgcccacctcggcctc

SEQ ID NO: 19722 - DNA, 32 bp, Homo sapiens
tcaccagccctgcactgatgtcactttatgta

SEQ ID NO: 19723 - DNA, 32 bp, Homo sapiens
ctctgtcgcccgggctggagtgctgtgagctg

SEQ ID NO: 19724 - DNA, 28 bp, Homo sapiens
ccggccttcgaggctgcctcctccaggc

SEQ ID NO: 19725 - DNA, 32 bp, Homo sapiens
ggctttccctgactctgcgacagggtcaaacc

SEQ ID NO: 19726 - DNA, 24 bp, Homo sapiens
tcacacctgtaattccaacacttt

SEQ ID NO: 19727 - DNA, 24 bp, Homo sapiens
tcacatctgtaatcccaacacttt

SEQ ID NO: 19728 - DNA, 32 bp, Homo sapiens
ctcttgttgcccaggctggagtgcaatgacac

SEQ ID NO: 19729 - DNA, 32 bp, Homo sapiens
actctgttgcccagctggagtgcagtggcgtg

SEQ ID NO: 19730 - DNA, 32 bp, Homo sapiens
taaactagaagaggaagaagaagaggaagtag

SEQ ID NO: 19731 - DNA, 32 bp, Homo sapiens
gacatatattaggtcagctcttacttttgaaa

SEQ ID NO: 19732 - DNA, 32 bp, Homo sapiens
agcctcctgagtagctgggactacaggcacat

SEQ ID NO: 19733 - DNA, 32 bp, Homo sapiens
ggctcctaactctcaggaaacacttgtcggct

SEQ ID NO: 19734 - DNA, 32 bp, Homo sapiens
ccaaccctgcatggtcaagtggtgctaaccca

SEQ ID NO: 19735 - DNA, 23 bp, Homo sapiens
catgcctgtaatcccagcacttt

SEQ ID NO: 19736 - DNA, 32 bp, Homo sapiens
aggctttgaagaggaggagatgcagaagataa

SEQ ID NO: 19737 - DNA, 32 bp, Homo sapiens
ctctaattcaagcgaatgttggaacaccatga

SEQ ID NO: 19738 - DNA, 32 bp, Homo sapiens
gaaaacatcagccattacattacttggctctg

SEQ ID NO: 19739 - DNA, 32 bp, Homo sapiens
gatcttcatgtacctgctcttctgtttgcaca

SEQ ID NO: 19740 - DNA, 32 bp, Homo sapiens
ttttagtgaaggtcagcagttttctaacttgt

SEQ ID NO: 19741 - DNA, 32 bp, Homo sapiens
ctctgcccctcacgttcctaccacagggccac

SEQ ID NO: 19742 - DNA, 32 bp, Homo sapiens
acttctgtgctgcttgcagtcatagctttcct

SEQ ID NO: 19743 - DNA, 18 bp, Homo sapiens
cagttctgccacccagga

SEQ ID NO: 19744 - DNA, 32 bp, Homo sapiens
ctcttgttgcccaggctggagtgcgttggcgt

SEQ ID NO: 19745 - DNA, 32 bp, Homo sapiens
tgctgttgcccaggctggagtgcagtgtcccg

SEQ ID NO: 19746 - DNA, 32 bp, Homo sapiens
tcttgtcaccgaggctggagtgcaatgacatg

SEQ ID NO: 19747 - DNA, 32 bp, Homo sapiens
tcctcagttcccagctgggattgctatgcact

SEQ ID NO: 19748 - DNA, 32 bp, Homo sapiens
tatcactcaagggggatgctgtggaaacctgg

SEQ ID NO: 19749 - DNA, 32 bp, Homo sapiens
ctcttgttgcccaggctggagtgcaatggtgc

SEQ ID NO: 19750 - DNA, 32 bp, Homo sapiens
attgagcgctgaatcgtgtcccatgagatcag

SEQ ID NO: 19751 - DNA, 32 bp, Homo sapiens
ctgggctcaagcaatcctctcatctccacctc

SEQ ID NO: 19752 - DNA, 20 bp, Homo sapiens
tgtggggtgggcagtgggga

SEQ ID NO: 19753 - DNA, 32 bp, Homo sapiens
gtttctcatcttctctctacggcctctgagtt

SEQ ID NO: 19754 - DNA, 32 bp, Homo sapiens
ggggagagaagagggaacgagcaagggaagga

SEQ ID NO: 19755 - DNA, 32 bp, Homo sapiens
gtaggagcaaacaaggcttcatattcttttta

SEQ ID NO: 19756 - DNA, 32 bp, Homo sapiens
ctgtgttgtccaggctggagtgcagtggtgtg

SEQ ID NO: 19757 - DNA, 32 bp, Homo sapiens
cccaagtgccgtcttagccattcagtgaaggg

SEQ ID NO: 19758 - DNA, 32 bp, Homo sapiens
actgacaggcctgatggagcttgtggctggcc

SEQ ID NO: 19759 - DNA, 32 bp, Homo sapiens
tttccaaggactgggagcaaacttgcaggctc

SEQ ID NO: 19760 - DNA, 32 bp, Homo sapiens
acagcatgcagtcttccatctgctttctcttc

SEQ ID NO: 19761 - DNA, 17 bp, Homo sapiens
gcccccgtgtccaggtg

SEQ ID NO: 19762 - DNA, 32 bp, Homo sapiens
agaggaaaggggtcttccctggaacgcttcag

SEQ ID NO: 19763 - DNA, 28 bp, Homo sapiens
ttctcaggtcatgctgcctctccctatc

SEQ ID NO: 19764 - DNA, 24 bp, Homo sapiens
gtcacccaggctggagtgcggtgg

SEQ ID NO: 19765 - DNA, 32 bp, Homo sapiens
aaataacaggagttcgttcagagaccatttct

SEQ ID NO: 19766 - DNA, 32 bp, Homo sapiens
tttgtgaaggtcagagatgctttgccagtctc

SEQ ID NO: 19767 - DNA, 32 bp, Homo sapiens
ctcttgcccagagctgtgcagtgcagtggctg

SEQ ID NO: 19768 - DNA, 32 bp, Homo sapiens
agggatagaagagttgaaaagggaaagcaaaa

SEQ ID NO: 19769 - DNA, 19 bp, Homo sapiens
gacggcccgcaggccgaga

SEQ ID NO: 19770 - DNA, 32 bp, Homo sapiens
ggggaagaaggaggagaagatgaagaagcacc

SEQ ID NO: 19771 - DNA, 32 bp, Homo sapiens
tggatgagtgtcaaagtgaatttgatttgtac

SEQ ID NO: 19772 - DNA, 18 bp, Homo sapiens
gccaccagtcatccagaa

SEQ ID NO: 19773 - DNA, 32 bp, Homo sapiens
gatttttatcttctcaccattttacctctttt

SEQ ID NO: 19774 - DNA, 32 bp, Homo sapiens
aaatgtacaccaggctgggtgcggtggctcac

SEQ ID NO: 19775 - DNA, 23 bp, Homo sapiens
tggcatgatctcggctcgctgca

SEQ ID NO: 19776 - DNA, 24 bp, Homo sapiens
tggcatgatcatggctcactgcag

SEQ ID NO: 19777 - DNA, 32 bp, Homo sapiens
tttgattctatggttccctcagtattacatct

SEQ ID NO: 19778 - DNA, 32 bp, Homo sapiens
agtctgtcaccaggctggagtgcagtggcatg

SEQ ID NO: 19779 - DNA, 32 bp, Homo sapiens
agaatgaggttagaagactgcagcttggagtc

SEQ ID NO: 19780 - DNA, 19 bp, Homo sapiens
tgcacagcaacccagcctt

SEQ ID NO: 19781 - DNA, 32 bp, Homo sapiens
acgaggggatggcagaggaggtgaggagggag

SEQ ID NO: 19782 - DNA, 32 bp, Homo sapiens
tcagggagccgtgcccttgaaagcggtgtatt

SEQ ID NO: 19783 - DNA, 24 bp, Homo sapiens
aagatttatgccagagccttgcag

SEQ ID NO: 19784 - DNA, 32 bp, Homo sapiens
tggcaggtggtctcctgggtagcaggatctgg

SEQ ID NO: 19785 - DNA, 32 bp, Homo sapiens
tgcattctactgtcacccatctggagcagctt

SEQ ID NO: 19786 - DNA, 32 bp, Homo sapiens
ctctgtaacccaggctggagtgcagtggcctg

SEQ ID NO: 19787 - DNA, 32 bp, Homo sapiens
tttctgcacatccttaccaacatttgttattg

SEQ ID NO: 19788 - DNA, 32 bp, Homo sapiens
tttcggtatctgctgttcacagctctccactg

SEQ ID NO: 19789 - DNA, 32 bp, Homo sapiens
ctgggctcacacaatccttccacctcagcatc

SEQ ID NO: 19790 - DNA, 22 bp, Homo sapiens
ctgtcaccaggctggagtgcag

SEQ ID NO: 19791 - DNA, 32 bp, Homo sapiens
aaaccaggaagagttgggctgtggaaggacat

SEQ ID NO: 19792 - DNA, 32 bp, Homo sapiens
gtcctggaccggagctgctcccggaactggca

SEQ ID NO: 19793 - DNA, 28 bp, Homo sapiens
ctcacccgaagggctgcctcactctgtg

SEQ ID NO: 19794 - DNA, 32 bp, Homo sapiens
gaacccccaaggcggagcttgcagtgagccga

SEQ ID NO: 19795 - DNA, 32 bp, Homo sapiens
ctactcgggaggctgaggcaggagaaccgctt

SEQ ID NO: 19796 - DNA, 32 bp, Homo sapiens
gaaccccagaggcggaggttgcagtgagccga

SEQ ID NO: 19797 - DNA, 24 bp, Homo sapiens
tcacacctataatcctagcgcttt

SEQ ID NO: 19798 - DNA, 32 bp, Homo sapiens
aaacccagaagaggagagcaaaggagtcagga

SEQ ID NO: 19799 - DNA, 32 bp, Homo sapiens
gaacccgagaggcggaggttgcagtgagccca

SEQ ID NO: 19800 - DNA, 32 bp, Homo sapiens
gaatgcaggagcaggagttgagcttgggagct

SEQ ID NO: 19801 - DNA, 24 bp, Homo sapiens
ctgtaactcaggctggagtgcagt

SEQ ID NO: 19802 - DNA, 32 bp, Homo sapiens
ggggctgctgcagcttctggggcctccacaga

SEQ ID NO: 19803 - DNA, 32 bp, Homo sapiens
gacttgcacctataatcccagcactttgggag

SEQ ID NO: 19804 - DNA, 32 bp, Homo sapiens
agtctcccaagtagctgggactattttgcatg

SEQ ID NO: 19805 - DNA, 32 bp, Homo sapiens
gttctgctgcccaagctggagtggcagtggca

SEQ ID NO: 19806 - DNA, 32 bp, Homo sapiens
cattcctcctaaggagctggtgtcttcatcca

SEQ ID NO: 19807 - DNA, 32 bp, Homo sapiens
ttaatctgcacagtttatcttctgccaaaata

SEQ ID NO: 19808 - DNA, 32 bp, Homo sapiens
tgtccactcctgccctcagtctggacctgccc

SEQ ID NO: 19809 - DNA, 32 bp, Homo sapiens
aacttttctatatttggtttctctccacacat

SEQ ID NO: 19810 - DNA, 32 bp, Homo sapiens
tatttgttgtttgtttgcttgtttttgttttt

SEQ ID NO: 19811 - DNA, 20 bp, Homo sapiens
aggggacctccttccagctc

SEQ ID NO: 19812 - DNA, 32 bp, Homo sapiens
ctctgtcatccaggctggagtgcagtggtgca

SEQ ID NO: 19813 - DNA, 32 bp, Homo sapiens
ttaaatgccacgttttcataccaagagtcatt

SEQ ID NO: 19814 - DNA, 32 bp, Homo sapiens
tgtatatgtacttgctttatctctttaccctt

SEQ ID NO: 19815 - DNA, 32 bp, Homo sapiens
actctgtcacctaggctggagtgcagtggcac

SEQ ID NO: 19816 - DNA, 32 bp, Homo sapiens
actttgtcacccaggctggagtgcagtggcac

SEQ ID NO: 19817 - DNA, 32 bp, Homo sapiens
ttctgtcacccaggctggagtgcagtggtgca

SEQ ID NO: 19818 - DNA, 32 bp, Homo sapiens
caaaattcaagcaattctcctgcctcagcctc

SEQ ID NO: 19819 - DNA, 32 bp, Homo sapiens
aaggacgccttctgcttggcagtattaactgg

SEQ ID NO: 19820 - DNA, 32 bp, Homo sapiens
gctttgtcgcccaggctggagtgcagtggcac

SEQ ID NO: 19821 - DNA, 32 bp, Homo sapiens
cactttgagaggcagaggcaggaggatcagga

SEQ ID NO: 19822 - DNA, 32 bp, Homo sapiens
aaagttccaagtgcaaaattacagtgtgttag

SEQ ID NO: 19823 - DNA, 32 bp, Homo sapiens
tgaggagaaaaaggagaaaagggaaaagcaga

SEQ ID NO: 19824 - DNA, 32 bp, Homo sapiens
agttgtggaggaggtgaaagaaagggacccac

SEQ ID NO: 19825 - DNA, 32 bp, Homo sapiens
cttaggtaaagaagagaaagagaaagcaaatt

SEQ ID NO: 19826 - DNA, 32 bp, Homo sapiens
gagttggcggatattcggaactgtgaatgtac

SEQ ID NO: 19827 - DNA, 32 bp, Homo sapiens
gtctgctctgcaggttcttcatacagctgcct

SEQ ID NO: 19828 - DNA, 32 bp, Homo sapiens
tgagggctacctagactcaggtgcaattcctt

SEQ ID NO: 19829 - DNA, 32 bp, Homo sapiens
tcttgtcacccaggctggagtgcagtggtgca

SEQ ID NO: 19830 - DNA, 32 bp, Homo sapiens
tgcattcctgggggctggagggtggggtgcca

SEQ ID NO: 19831 - DNA, 32 bp, Homo sapiens
acagtcagctgggctgagtgtattccaaacgg

SEQ ID NO: 19832 - DNA, 32 bp, Homo sapiens
ggctcatgcctgtaatccgagcactttgggag

SEQ ID NO: 19833 - DNA, 32 bp, Homo sapiens
tcttgttgcccaggctggagtgcagtggtgtg

SEQ ID NO: 19834 - DNA, 32 bp, Homo sapiens
tcttgttgcccaggctggagtacagtggtatg

SEQ ID NO: 19835 - DNA, 32 bp, Homo sapiens
acttccgcttcccaggttcaagcaattttcct

SEQ ID NO: 19836 - DNA, 32 bp, Homo sapiens
ggccagggaagaggaggaagaagaggaggagg

SEQ ID NO: 19837 - DNA, 32 bp, Homo sapiens
acttacctgagagtgagagatgtgtaggaaga

SEQ ID NO: 19838 - DNA, 32 bp, Homo sapiens
agtcatgggaggcagagctgggggagcgaggc

SEQ ID NO: 19839 - DNA, 24 bp, Homo sapiens
tcttgcctgtaatcccagcacttt

SEQ ID NO: 19840 - DNA, 21 bp, Homo sapiens
gtgccgccagtggtccaagga

SEQ ID NO: 19841 - DNA, 23 bp, Homo sapiens
gatgaggaaactgaagttgagga

SEQ ID NO: 19842 - DNA, 32 bp, Homo sapiens
gcccaggaacccagactggacttcagtctccc

SEQ ID NO: 19843 - DNA, 32 bp, Homo sapiens
tgagaagggaaaaaggaaagaaaaattgaggg

SEQ ID NO: 19844 - DNA, 32 bp, Homo sapiens
tgtccgtctgcagctgcgtgactgtctgtctc

SEQ ID NO: 19845 - DNA, 32 bp, Homo sapiens
agctgccatggtggttaggaatgtgatacatg

SEQ ID NO: 19846 - DNA, 32 bp, Homo sapiens
gctctgtcacctaggctggagtgcagtggcat

SEQ ID NO: 19847 - DNA, 32 bp, Homo sapiens
gctttgtcacccaggctggagtacagtggcgt

SEQ ID NO: 19848 - DNA, 32 bp, Homo sapiens
aagcaggaaataggagaaaagtaaacaacttt

SEQ ID NO: 19849 - DNA, 32 bp, Homo sapiens
gaacccgggaggtggagcttgcagtgggtgga

SEQ ID NO: 19850 - DNA, 32 bp, Homo sapiens
atgtacttttctgcataatttctgccttctgt

SEQ ID NO: 19851 - DNA, 32 bp, Homo sapiens
ataatacatcttccacacatttggcccactga

SEQ ID NO: 19852 - DNA, 32 bp, Homo sapiens
tcttgtcatcttctcatcctctgcgccaagaa

SEQ ID NO: 19853 - DNA, 32 bp, Homo sapiens
ctgctaacagccagagtgtcccagaagctttt

SEQ ID NO: 19854 - DNA, 32 bp, Homo sapiens
aaatacagcctgtcactgtgtgacacagattg

SEQ ID NO: 19855 - DNA, 32 bp, Homo sapiens
aagtcaggccctggttctcttctgtcttgttt

SEQ ID NO: 19856 - DNA, 32 bp, Homo sapiens
tctctgtcaccaggctgtattacagtggtgca

SEQ ID NO: 19857 - DNA, 32 bp, Homo sapiens
tagatatggagtttcaccacgttggccaagac

SEQ ID NO: 19858 - DNA, 18 bp, Homo sapiens
gccatcaccacctcggaa

SEQ ID NO: 19859 - DNA, 32 bp, Homo sapiens
ctgtcatgcccagcttggagtgccacgtggcc

SEQ ID NO: 19860 - DNA, 30 bp, Homo sapiens
aaggaatgcccaggagagagcacatggttg

SEQ ID NO: 19861 - DNA, 32 bp, Homo sapiens
aatatgtttcgtttgctcaacatggtttacta

SEQ ID NO: 19862 - DNA, 32 bp, Homo sapiens
agcctcctgagtagctgggattacaggcatcc

SEQ ID NO: 19863 - DNA, 32 bp, Homo sapiens
agcctcccgagtagctgggattacaggcatct

SEQ ID NO: 19864 - DNA, 32 bp, Homo sapiens
ctcttgtcacccaggctggagtacaatgatgc

SEQ ID NO: 19865 - DNA, 32 bp, Homo sapiens
ccaggaagcccggcaggagaattctgccagat

SEQ ID NO: 19866 - DNA, 32 bp, Homo sapiens
tgtgccttgcctctgccctccacgccgccgcc

SEQ ID NO: 19867 - DNA, 32 bp, Homo sapiens
agccttccgagtagctgggattacaggcacct

SEQ ID NO: 19868 - DNA, 32 bp, Homo sapiens
tgctctgctgggtcagcatctccagccacctg

SEQ ID NO: 19869 - DNA, 32 bp, Homo sapiens
gaacccgagaggcggaagttgcagtgagccga

SEQ ID NO: 19870 - DNA, 32 bp, Homo sapiens
ctgggcccaagcaattctcccacctcagcctc

SEQ ID NO: 19871 - DNA, 32 bp, Homo sapiens
cctggtgcctgcggcatccttctgcctgtttc

SEQ ID NO: 19872 - DNA, 32 bp, Homo sapiens
aatcctactttcagcgtcattctgccttttgt

SEQ ID NO: 19873 - DNA, 32 bp, Homo sapiens
ctgttcacgtctctccccagtgggctcctaag

SEQ ID NO: 19874 - DNA, 32 bp, Homo sapiens
ctctgtcacccaggctggagtgctgtggtgca

SEQ ID NO: 19875 - DNA, 32 bp, Homo sapiens
ctctgtctcccaggctggagtgcagtggtgca

SEQ ID NO: 19876 - DNA, 32 bp, Homo sapiens
tacagagaaatcacagacttttgctacaaatc

SEQ ID NO: 19877 - DNA, 32 bp, Homo sapiens
atcgtaaatgttctgaagacgagcagctggag

SEQ ID NO: 19878 - DNA, 32 bp, Homo sapiens
tctctgttgcccaggctgcagtgcagtggtgc

SEQ ID NO: 19879 - DNA, 32 bp, Homo sapiens
attctgtcacccaggctggagtgcagtggtgc

SEQ ID NO: 19880 - DNA, 32 bp, Homo sapiens
gaacctgggaggtagaggttgcagtgagccaa

SEQ ID NO: 19881 - DNA, 32 bp, Homo sapiens
ttaactccaagtgcctttttgacagtgacaac

SEQ ID NO: 19882 - DNA, 32 bp, Homo sapiens
tggaaattcaactaatttttggtgctattatt

SEQ ID NO: 19883 - DNA, 32 bp, Homo sapiens
cacatgggtaggtcagttctttggtccaagcc

SEQ ID NO: 19884 - DNA, 17 bp, Homo sapiens
gcccctgccctctgtgg

SEQ ID NO: 19885 - DNA, 32 bp, Homo sapiens
gaagtcccttggggagggttgcagagagagtg

SEQ ID NO: 19886 - DNA, 18 bp, Homo sapiens
gcaagtgacatgccatcc

SEQ ID NO: 19887 - DNA, 21 bp, Homo sapiens
tgaccacacaggcacctgcct

SEQ ID NO: 19888 - DNA, 32 bp, Homo sapiens
aagagctctgcaggctttccactgcctgtatt

SEQ ID NO: 19889 - DNA, 32 bp, Homo sapiens
ctctgtcgcccaggctggagtgcagtgccgcg

SEQ ID NO: 19890 - DNA, 32 bp, Homo sapiens
cctgaaggccaagcttgtcactgtgaatgagg

SEQ ID NO: 19891 - DNA, 24 bp, Homo sapiens
tggcacaatcatacctcactgcag

SEQ ID NO: 19892 - DNA, 32 bp, Homo sapiens
tgtggtttctgggagctggttcttaatttggc

SEQ ID NO: 19893 - DNA, 32 bp, Homo sapiens
ctctgtcacccagactggagtgcagtgccaca

SEQ ID NO: 19894 - DNA, 32 bp, Homo sapiens
aacagtaggtccaggctggatgctggtatgat

SEQ ID NO: 19895 - DNA, 32 bp, Homo sapiens
gcatgggggaggcacagaatgctggagagatg

SEQ ID NO: 19896 - DNA, 28 bp, Homo sapiens
gctcatctttggattgcctcatcatccc

SEQ ID NO: 19897 - DNA, 32 bp, Homo sapiens
cagagcccagttaattctccgcacctcggttg

SEQ ID NO: 19898 - DNA, 32 bp, Homo sapiens
gaactcgggaggtgaaagttgcagtgagccga

SEQ ID NO: 19899 - DNA, 32 bp, Homo sapiens
ggaacgtggaggcagaggttgcagtgagccga

SEQ ID NO: 19900 - DNA, 32 bp, Homo sapiens
gaacccggaaggcggaggttgcagtgagccaa

SEQ ID NO: 19901 - DNA, 32 bp, Homo sapiens
agcacagacgtggggcatccccagaaagactc

SEQ ID NO: 19902 - DNA, 32 bp, Homo sapiens
tctgatgcttcttttgtcaggtgcagaagcac

SEQ ID NO: 19903 - DNA, 25 bp, Homo sapiens
tcatacctgttaattccagcacttt

SEQ ID NO: 19904 - DNA, 32 bp, Homo sapiens
gcctctctcctgctgctcctccagctgtatct

SEQ ID NO: 19905 - DNA, 22 bp, Homo sapiens
gtcacccaggctggagtccaat

SEQ ID NO: 19906 - DNA, 32 bp, Homo sapiens
tgacagtaacccctacctcacagggttgttgt

SEQ ID NO: 19907 - DNA, 32 bp, Homo sapiens
gagggcaggcctgtatcttttacttctgtgta

SEQ ID NO: 19908 - DNA, 32 bp, Homo sapiens
tataagccagcaacaggaacttttgtgaagac

SEQ ID NO: 19909 - DNA, 32 bp, Homo sapiens
gcattccagccagcagggcagtctcagtgtgg

SEQ ID NO: 19910 - DNA, 32 bp, Homo sapiens
ctactcgggaggccgaggcaggagaattgcgt

SEQ ID NO: 19911 - DNA, 28 bp, Homo sapiens
ggggctccaagtgccttgttcatccttt

SEQ ID NO: 19912 - DNA, 32 bp, Homo sapiens
ccatgctgagcatcctggaggacctggagagc

SEQ ID NO: 19913 - DNA, 32 bp, Homo sapiens
aagaggtgtaggtcggcttggttttctgctac

SEQ ID NO: 19914 - DNA, 32 bp, Homo sapiens
tgggacgggaggcgggagggggctggtggtgc

SEQ ID NO: 19915 - DNA, 32 bp, Homo sapiens
ttgatctgcccaggaaagggatgcattgacac

SEQ ID NO: 19916 - DNA, 32 bp, Homo sapiens
tcaagagccatcttcgatctttgcggcctgag

SEQ ID NO: 19917 - DNA, 21 bp, Homo sapiens
agagaggcccgcccgcccacc

SEQ ID NO: 19918 - DNA, 32 bp, Homo sapiens
ctggggtccagcgctgcccccacctcaactcc

SEQ ID NO: 19919 - DNA, 32 bp, Homo sapiens
cggctgtgagctgcgctctccacgccggctcc

SEQ ID NO: 19920 - DNA, 32 bp, Homo sapiens
agcttcctaaagtgctgggattactggcatga

SEQ ID NO: 19921 - DNA, 32 bp, Homo sapiens
gtcttgaactcctgagttcaagcagtcctcct

SEQ ID NO: 19922 - DNA, 32 bp, Homo sapiens
ccaggctcaagcaattctcctgcctcaacctt

SEQ ID NO: 19923 - DNA, 32 bp, Homo sapiens
aaaccaaatggttacattgtgctgctagaaat

SEQ ID NO: 19924 - DNA, 32 bp, Homo sapiens
cttcccagtggctgcttcctggggacccaggg

SEQ ID NO: 19925 - DNA, 32 bp, Homo sapiens
gtctcaagctcctgggctcaagcaatctgctt

SEQ ID NO: 19926 - DNA, 24 bp, Homo sapiens
tcaggcctgtaatcccaacacttt

SEQ ID NO: 19927 - DNA, 32 bp, Homo sapiens
gaaccggggaggtggaggctgcagtgagccga

SEQ ID NO: 19928 - DNA, 32 bp, Homo sapiens
agattctcaaaccacacgtgctttgttaaagc

SEQ ID NO: 19929 - DNA, 32 bp, Homo sapiens
gccttcttgctgctgtcacgttccaagagaac

SEQ ID NO: 19930 - DNA, 23 bp, Homo sapiens
gtcgcccaggctggagtgtggtg

SEQ ID NO: 19931 - DNA, 32 bp, Homo sapiens
aacctgggtgatagagcaagtctctgtcttta

SEQ ID NO: 19932 - DNA, 32 bp, Homo sapiens
ttgagacagagtttggctcttgttgcccaggc

SEQ ID NO: 19933 - DNA, 32 bp, Homo sapiens
ttgagagggagtttcactcttgttgcccaggc

SEQ ID NO: 19934 - DNA, 32 bp, Homo sapiens
ttgagacagagtttcgctcttgttgcccagcc

SEQ ID NO: 19935 - DNA, 32 bp, Homo sapiens
gctatgttgcccaggctagagtgcagtggcta

SEQ ID NO: 19936 - DNA, 32 bp, Homo sapiens
cctgcatgcccaggcttgtgagccaaggtgct

SEQ ID NO: 19937 - DNA, 32 bp, Homo sapiens
gtaatcagtgcatttgaaaattcaagccagca

SEQ ID NO: 19938 - DNA, 32 bp, Homo sapiens
atcctcctgagtagctgggattacaggtgcct

SEQ ID NO: 19939 - DNA, 32 bp, Homo sapiens
ctttgacacccaggctggagtgcagtggtgcc

SEQ ID NO: 19940 - DNA, 32 bp, Homo sapiens
tcccttgcctccatgcaattctgaacttcaga

SEQ ID NO: 19941 - DNA, 32 bp, Homo sapiens
ctattcgggaggctgaggcaggagaatcgcgt

SEQ ID NO: 19942 - DNA, 32 bp, Homo sapiens
acctctgcttcccgggttcaagcagtttcctg

SEQ ID NO: 19943 - DNA, 32 bp, Homo sapiens
ctcccccagagtactccccactgtgaaaagag

SEQ ID NO: 19944 - DNA, 32 bp, Homo sapiens
actgttctgctgctgatcacgagggcaccaga

SEQ ID NO: 19945 - DNA, 32 bp, Homo sapiens
atcccactcccggcggcccaggcacagaaggg

SEQ ID NO: 19946 - DNA, 32 bp, Homo sapiens
cctctgttgcccaggctggagtgcagaggtgc

SEQ ID NO: 19947 - DNA, 32 bp, Homo sapiens
gggaagaggaaaacgaggcaagatgctgagaa

SEQ ID NO: 19948 - DNA, 32 bp, Homo sapiens
tacaactgagttctgtctggcccagaaccagc

SEQ ID NO: 19949 - DNA, 32 bp, Homo sapiens
aacagaggggaagggagctctttcttacattt

SEQ ID NO: 19950 - DNA, 32 bp, Homo sapiens
agcctccggagtagctgggattgcaggcaccc

SEQ ID NO: 19951 - DNA, 32 bp, Homo sapiens
tgctctgtcatcaggctggagtgcagtggctc

SEQ ID NO: 19952 - DNA, 32 bp, Homo sapiens
gagcccaggaggtggaggttgcagtgagcaga

SEQ ID NO: 19953 - DNA, 32 bp, Homo sapiens
gtctcaacctcctgggctcaagcaatcctcct

SEQ ID NO: 19954 - DNA, 28 bp, Homo sapiens
gctttcctacatgctgcctctcctcagg

SEQ ID NO: 19955 - DNA, 32 bp, Homo sapiens
acccctcgcagctgcttccttctgcctgggat

SEQ ID NO: 19956 - DNA, 19 bp, Homo sapiens
gccaaggtgtgtcccggga

SEQ ID NO: 19957 - DNA, 32 bp, Homo sapiens
ctcacctatcttctctcttgctccatctacca

SEQ ID NO: 19958 - DNA, 32 bp, Homo sapiens
gaagtaaatgttctgagtggagctactaggat

SEQ ID NO: 19959 - DNA, 32 bp, Homo sapiens
agaacctacttaagatagaacatggttttggc

SEQ ID NO: 19960 - DNA, 21 bp, Homo sapiens
tccaggccctgcatgccgtca

SEQ ID NO: 19961 - DNA, 24 bp, Homo sapiens
tcacacctgaaatcccagcacttt

SEQ ID NO: 19962 - DNA, 32 bp, Homo sapiens
cggcacccatggtgtgctggatcatgtgcatg

SEQ ID NO: 19963 - DNA, 28 bp, Homo sapiens
cacctctccagtgctgcctgcagtcagc

SEQ ID NO: 19964 - DNA, 32 bp, Homo sapiens
agcctcctcacaacatgacagctggcttagta

SEQ ID NO: 19965 - DNA, 32 bp, Homo sapiens
tctgtgccttcggaggtctttctgcctgcctg

SEQ ID NO: 19966 - DNA, 32 bp, Homo sapiens
gtctggggcactctgcaggttctgcctttgag

SEQ ID NO: 19967 - DNA, 32 bp, Homo sapiens
ctgtctcccaggctgctggagtgcagtggcac

SEQ ID NO: 19968 - DNA, 32 bp, Homo sapiens
gcaacctcccactgctggagtgcgagtgggaa

SEQ ID NO: 19969 - DNA, 32 bp, Homo sapiens
cttccggaacatgttcttcaccaccttttgga

SEQ ID NO: 19970 - DNA, 32 bp, Homo sapiens
actgcctgcttgaaagcactttctgacctaca

SEQ ID NO: 19971 - DNA, 32 bp, Homo sapiens
ctgaacataataccatctgcagtattataaaa

SEQ ID NO: 19972 - DNA, 32 bp, Homo sapiens
aacgtccaccaaccaggaaacacctgcctcca

SEQ ID NO: 19973 - DNA, 32 bp, Homo sapiens
ggacctcaagcagacttcctagagacttgttt

SEQ ID NO: 19974 - DNA, 32 bp, Homo sapiens
gtgggagagagaggagacagaaagagcgagcg

SEQ ID NO: 19975 - DNA, 32 bp, Homo sapiens
gaacctaggaggctgagattgcagtgagccga

SEQ ID NO: 19976 - DNA, 32 bp, Homo sapiens
cagcccgggaggtggaggttgcagtgagccaa

SEQ ID NO: 19977 - DNA, 32 bp, Homo sapiens
atcttctcaggctcactgagtgcaatgtctgc

SEQ ID NO: 19978 - DNA, 32 bp, Homo sapiens
aaacatccctcagccccacaggcacgatctgt

SEQ ID NO: 19979 - DNA, 26 bp, Homo sapiens
agtgttgggaaactggattcagtggg

SEQ ID NO: 19980 - DNA, 32 bp, Homo sapiens
ctgggttcacgccattctcccgcctcagcctc

SEQ ID NO: 19981 - DNA, 32 bp, Homo sapiens
agaaaccccaaaccaggaaaccccacctaccc

SEQ ID NO: 19982 - DNA, 32 bp, Homo sapiens
gctctgtcgctcgcgctggagtgcagtggcat

SEQ ID NO: 19983 - DNA, 32 bp, Homo sapiens
gagatttcaagtcgtactatggaacacctttc

SEQ ID NO: 19984 - DNA, 32 bp, Homo sapiens
ctgaactcaagtgatccgcccacctcagcctc

SEQ ID NO: 19985 - DNA, 32 bp, Homo sapiens
ctattggatacttaggtggtttcttcactgac

SEQ ID NO: 19986 - DNA, 32 bp, Homo sapiens
agtctggctccggtcactcttctggcttaggt

SEQ ID NO: 19987 - DNA, 21 bp, Homo sapiens
tgtggggccccagagagggga

SEQ ID NO: 19988 - DNA, 32 bp, Homo sapiens
ctggcctcaagcaatcctctctcctcagcctc

SEQ ID NO: 19989 - DNA, 32 bp, Homo sapiens
tcttgtcacccaggctggagtgcaatggcacg

SEQ ID NO: 19990 - DNA, 32 bp, Homo sapiens
tcttgttgcccaggctggagtgcaatggcata

SEQ ID NO: 19991 - DNA, 28 bp, Homo sapiens
caagactcccatgctgcctcatttgtat

SEQ ID NO: 19992 - DNA, 17 bp, Homo sapiens
gccgcgctgtccaggtg

SEQ ID NO: 19993 - DNA, 24 bp, Homo sapiens
tcacgcctgtaatcccaccacttt

SEQ ID NO: 19994 - DNA, 32 bp, Homo sapiens
gagcccaggaggtcgaggttgcagtgagcagt

SEQ ID NO: 19995 - DNA, 32 bp, Homo sapiens
gcttcagcaggagatccttcccagaaggttga

SEQ ID NO: 19996 - DNA, 32 bp, Homo sapiens
catggcagcctacatggcattacttgtgacca

SEQ ID NO: 19997 - DNA, 32 bp, Homo sapiens
atcccactccttctccccatttctgtcccaca

SEQ ID NO: 19998 - DNA, 32 bp, Homo sapiens
agcagcctgcaagctgggagcttgcatgggtg

SEQ ID NO: 19999 - DNA, 32 bp, Homo sapiens
gcgctgtcacccaggctggagtgcagtgctgc

SEQ ID NO: 20000 - DNA, 32 bp, Homo sapiens
tgggatctgccaggctggggtgttttcggtat

SEQ ID NO: 20001 - DNA, 32 bp, Homo sapiens
ttctcagtgctctcctaccccacctcatgcct

SEQ ID NO: 20002 - DNA, 32 bp, Homo sapiens
ctgggctcaagtaatcctcccaccccagcctc

SEQ ID NO: 20003 - DNA, 24 bp, Homo sapiens
cccggagcccccgcggacgccggc

SEQ ID NO: 20004 - DNA, 32 bp, Homo sapiens
agtctcagcttatcctggagggaattgggaac

SEQ ID NO: 20005 - DNA, 32 bp, Homo sapiens
ggagtaagaagaggattaaaaaggaaaggcaa

SEQ ID NO: 20006 - DNA, 32 bp, Homo sapiens
cttttagagccagagggaattatttattaagc

SEQ ID NO: 20007 - DNA, 23 bp, Homo sapiens
tgacacgatcttgtctcactgca

SEQ ID NO: 20008 - DNA, 24 bp, Homo sapiens
tgacacaatcatagctcactgcag

SEQ ID NO: 20009 - DNA, 32 bp, Homo sapiens
ctgacctccagtgatctgcccacctcggcctc

SEQ ID NO: 20010 - DNA, 32 bp, Homo sapiens
gctctgtcgcccaggctggagtgcagtggtgg

SEQ ID NO: 20011 - DNA, 32 bp, Homo sapiens
gtcacctagactagactggagtgcaatggcct

SEQ ID NO: 20012 - DNA, 32 bp, Homo sapiens
ggaactgggaggcaggtttggaggctgcagtg

SEQ ID NO: 20013 - DNA, 32 bp, Homo sapiens
aggacgaggaggcagcaggagcagtgacggtg

SEQ ID NO: 20014 - DNA, 32 bp, Homo sapiens
tcctccgcctcccgggttcaagcaatgctccc

SEQ ID NO: 20015 - DNA, 19 bp, Homo sapiens
caggatgagcctccagctc

SEQ ID NO: 20016 - DNA, 32 bp, Homo sapiens
ttcaagtgctgcctgctcactgaccaactgcc

SEQ ID NO: 20017 - DNA, 32 bp, Homo sapiens
gcccgggtcttgctccccattggccgccacct

SEQ ID NO: 20018 - DNA, 32 bp, Homo sapiens
tcttggaaaggttctattcctgatctccagct

SEQ ID NO: 20019 - DNA, 32 bp, Homo sapiens
ctcttgttgtccaggctggagtgcaatggcac

SEQ ID NO: 20020 - DNA, 32 bp, Homo sapiens
gctctgtcacccaagcaggattgcagtgagcc

SEQ ID NO: 20021 - DNA, 32 bp, Homo sapiens
ccaggttcaagcaattctcctgcctcaccctc

SEQ ID NO: 20022 - DNA, 32 bp, Homo sapiens
ccaggttcaagcaattctcgtgcctcagcctc

SEQ ID NO: 20023 - DNA, 32 bp, Homo sapiens
tgtcacccaggtggctggagtacagtggcctg

SEQ ID NO: 20024 - DNA, 32 bp, Homo sapiens
ctgctatctgcagctcctaggtgctttcctca

SEQ ID NO: 20025 - DNA, 32 bp, Homo sapiens
ctactcgggaggctgaagcaggagatttgctt

SEQ ID NO: 20026 - DNA, 32 bp, Homo sapiens
tcagtgggtgggcagaggtttagaaaggtggt

SEQ ID NO: 20027 - DNA, 20 bp, Homo sapiens
caggcggcgcgctccagccc

SEQ ID NO: 20028 - DNA, 32 bp, Homo sapiens
gagtgccgcccaaggtcacaggcacagaacct

SEQ ID NO: 20029 - DNA, 32 bp, Homo sapiens
ttctctatgcactcttatattctgcctttctg

SEQ ID NO: 20030 - DNA, 32 bp, Homo sapiens
tttatttgaattacccgaatagcaatatgtaa

SEQ ID NO: 20031 - DNA, 32 bp, Homo sapiens
tccattccagttctctgattatagaatccaga

SEQ ID NO: 20032 - DNA, 32 bp, Homo sapiens
aatcataatccttttgctgcttatctgatgtt

SEQ ID NO: 20033 - DNA, 32 bp, Homo sapiens
attttgaatgttctctttggcaacttatccat

SEQ ID NO: 20034 - DNA, 32 bp, Homo sapiens
tgactgaggttagggaggacgcccgagacccc

SEQ ID NO: 20035 - DNA, 32 bp, Homo sapiens
ttctgtggccctggctggagttcagtggtgtg

SEQ ID NO: 20036 - DNA, 32 bp, Homo sapiens
agcctccccagtagctgggattacaggcgtgg

SEQ ID NO: 20037 - DNA, 32 bp, Homo sapiens
cgccgctcatcaacaggaaagcttgggaaaga

SEQ ID NO: 20038 - DNA, 32 bp, Homo sapiens
ggttgtggggtgagaggatgtgagtggccggg

SEQ ID NO: 20039 - DNA, 32 bp, Homo sapiens
agcgggggcagaggccaagtgggcaccggata

SEQ ID NO: 20040 - DNA, 32 bp, Homo sapiens
tccatcccaagtgcctgcggagcccgaggaga

SEQ ID NO: 20041 - DNA, 24 bp, Homo sapiens
tcatacctgtaatcccagcagttt

SEQ ID NO: 20042 - DNA, 32 bp, Homo sapiens
agagttggaagaggagactgggaggcagcaag

SEQ ID NO: 20043 - DNA, 32 bp, Homo sapiens
cacgtcagaagaggttggggcaaaacaaaaca

SEQ ID NO: 20044 - DNA, 21 bp, Homo sapiens
ctgcaagagcctggctgggaa

SEQ ID NO: 20045 - DNA, 18 bp, Homo sapiens
gggagaaagaaatgggga

SEQ ID NO: 20046 - DNA, 32 bp, Homo sapiens
tgttcatcccttgaccacctctggaccactaa

SEQ ID NO: 20047 - DNA, 32 bp, Homo sapiens
gcttgcccaaaaggctggagagggcagggagc

SEQ ID NO: 20048 - DNA, 32 bp, Homo sapiens
gtggatgaggagaagaagcaggtgaccatgga

SEQ ID NO: 20049 - DNA, 32 bp, Homo sapiens
accactgcagaactgaaccacttcggccgtga

SEQ ID NO: 20050 - DNA, 32 bp, Homo sapiens
actctgttgcctagactggagtgcaatggcgt

SEQ ID NO: 20051 - DNA, 32 bp, Homo sapiens
gctttgtcacccaggctggagtgcaatggcac

SEQ ID NO: 20052 - DNA, 32 bp, Homo sapiens
ctctgtcactgaggctggagtgcagtggcgca

SEQ ID NO: 20053 - DNA, 32 bp, Homo sapiens
ccgacctcaagtgatcctcccacctcaccctc

SEQ ID NO: 20054 - DNA, 32 bp, Homo sapiens
cttggagggcctccttggcaatgcatttgatg

SEQ ID NO: 20055 - DNA, 32 bp, Homo sapiens
agtttgttgcccaggctggagtgagtggcaca

SEQ ID NO: 20056 - DNA, 24 bp, Homo sapiens
tcacgcctgtagtcccaacacttt

SEQ ID NO: 20057 - DNA, 32 bp, Homo sapiens
ctacccgggaggcagtggctgcagtgagctga

SEQ ID NO: 20058 - DNA, 28 bp, Homo sapiens
accgcgacccggggcgcctcatcctcag

SEQ ID NO: 20059 - DNA, 32 bp, Homo sapiens
gtctgtctcttttcttctcttcaaaaactttg

SEQ ID NO: 20060 - DNA, 32 bp, Homo sapiens
ggcccacctcttctccaagctggccttctgtt

SEQ ID NO: 20061 - DNA, 32 bp, Homo sapiens
gaatgatatcttctctttctttgaaccatctc

SEQ ID NO: 20062 - DNA, 32 bp, Homo sapiens
tgacaggtgctgctgcctctgagccctccctg

SEQ ID NO: 20063 - DNA, 32 bp, Homo sapiens
tccctcagcctccaggcttcagtcttcccaac

SEQ ID NO: 20064 - DNA, 21 bp, Homo sapiens
ggtctgagccttgcctggggc

SEQ ID NO: 20065 - DNA, 32 bp, Homo sapiens
acagagaatcagctggatcatttcagctgtcc

SEQ ID NO: 20066 - DNA, 32 bp, Homo sapiens
ttttgtaatcagctactgtatgttttatttta

SEQ ID NO: 20067 - DNA, 32 bp, Homo sapiens
cagtggagttcccaggccttgtttgcaggaag

SEQ ID NO: 20068 - DNA, 32 bp, Homo sapiens
gcccaacaactttgaactggcctggggatttc

SEQ ID NO: 20069 - DNA, 32 bp, Homo sapiens
taatctggaccaggctgtgggtagatgtgcaa

SEQ ID NO: 20070 - DNA, 32 bp, Homo sapiens
ggaaggaaagccattaatctttgcacagtacc

SEQ ID NO: 20071 - DNA, 32 bp, Homo sapiens
acttcaaggcctgggcccctctgggcttcagt

SEQ ID NO: 20072 - DNA, 32 bp, Homo sapiens
agcctcccaaagtgctgggattataggcatga

SEQ ID NO: 20073 - DNA, 32 bp, Homo sapiens
ggcctcctgaagtgctgggattacaggcatga

SEQ ID NO: 20074 - DNA, 32 bp, Homo sapiens
atctctgcttcccgggttcaagcaattcttct

SEQ ID NO: 20075 - DNA, 32 bp, Homo sapiens
gaaagggccagtgcccttatacaaagactgga

SEQ ID NO: 20076 - DNA, 32 bp, Homo sapiens
ctaggctcaagcgatcctcccacctcaacctc

SEQ ID NO: 20077 - DNA, 32 bp, Homo sapiens
gctcactataaccttgaactcctgggctcaag

SEQ ID NO: 20078 - DNA, 32 bp, Homo sapiens
ctgggcgcagacttcaccttctggaccttctc

SEQ ID NO: 20079 - DNA, 32 bp, Homo sapiens
gaacctgggaggcagagcttgcagtgagtgga

SEQ ID NO: 20080 - DNA, 32 bp, Homo sapiens
gtgtgggatacttagtggtatgtctctttaag

SEQ ID NO: 20081 - DNA, 32 bp, Homo sapiens
attgctgatacttgaataatcaatctctacta

SEQ ID NO: 20082 - DNA, 32 bp, Homo sapiens
atgttacattcaaagctcttgttttcatcaca

SEQ ID NO: 20083 - DNA, 32 bp, Homo sapiens
ctgggctcaagcgatctgcccacctcagtctc

SEQ ID NO: 20084 - DNA, 32 bp, Homo sapiens
ggcacatgcctgtaatcccagcactttgggaa

SEQ ID NO: 20085 - DNA, 32 bp, Homo sapiens
ggtttgtttctggggagctcttaatttctatt

SEQ ID NO: 20086 - DNA, 28 bp, Homo sapiens
agaaccagaggtgctgccttccctgtct

SEQ ID NO: 20087 - DNA, 32 bp, Homo sapiens
cgtgctgcgcgcacaccttcagctccatgtcg

SEQ ID NO: 20088 - DNA, 32 bp, Homo sapiens
acctgctctgcagctgctataaatagcctccc

SEQ ID NO: 20089 - DNA, 32 bp, Homo sapiens
ggaaactctgcagctttgtcatctaactcttc

SEQ ID NO: 20090 - DNA, 32 bp, Homo sapiens
gcccctccatgcctgcttggtgcagtgctctc

SEQ ID NO: 20091 - DNA, 32 bp, Homo sapiens
aaacaaaagcattttgctaaggagaagctaat

SEQ ID NO: 20092 - DNA, 32 bp, Homo sapiens
tagagatggagtttcactctgtttcccaggct

SEQ ID NO: 20093 - DNA, 32 bp, Homo sapiens
ggctcatgcctgtaatcccagcactttgatag

SEQ ID NO: 20094 - DNA, 32 bp, Homo sapiens
ctcttgttgcccaggctgggagggcaatggca

SEQ ID NO: 20095 - DNA, 32 bp, Homo sapiens
attctgttgcctaggctggagtgcagtggcgc

SEQ ID NO: 20096 - DNA, 28 bp, Homo sapiens
cagggacccactgctgcctcttccagga

SEQ ID NO: 20097 - DNA, 32 bp, Homo sapiens
caggtgcctctgtggtctcttctcatcctcac

SEQ ID NO: 20098 - DNA, 32 bp, Homo sapiens
cttctgccaagtgcttttctcagttgaaaact

SEQ ID NO: 20099 - DNA, 32 bp, Homo sapiens
ctactcgggaggctgaggcaagagaatggcat

SEQ ID NO: 20100 - DNA, 32 bp, Homo sapiens
ctcttgttgcccaggccagagtgcaatggcgt

SEQ ID NO: 20101 - DNA, 32 bp, Homo sapiens
ctctgttgcccaggctggagtgcagtgtcaca

SEQ ID NO: 20102 - DNA, 32 bp, Homo sapiens
agaggccaggttgaggggattacttgagccca

SEQ ID NO: 20103 - DNA, 24 bp, Homo sapiens
tcatgcctgtaacctcagcacttt

SEQ ID NO: 20104 - DNA, 32 bp, Homo sapiens
caacctgggaggttgaggctgcagtgagctgt

SEQ ID NO: 20105 - DNA, 32 bp, Homo sapiens
gtatctgggaggcagagtttgccgtgagctga

SEQ ID NO: 20106 - DNA, 32 bp, Homo sapiens
ggtcccggaagtgacgtctcccagaggggccg

SEQ ID NO: 20107 - DNA, 32 bp, Homo sapiens
tcctcacagtgaacactcagtggcccatggca

SEQ ID NO: 20108 - DNA, 32 bp, Homo sapiens
acaccattgctgttccccatctggtactaatg

SEQ ID NO: 20109 - DNA, 32 bp, Homo sapiens
tcgctgttacccaggctggagtgcaatggcgc

SEQ ID NO: 20110 - DNA, 32 bp, Homo sapiens
agcacccagagtgagctggagtgggtccccat

SEQ ID NO: 20111 - DNA, 32 bp, Homo sapiens
gccgcaccatttctgtcactcacatggaccca

SEQ ID NO: 20112 - DNA, 32 bp, Homo sapiens
acacattggagcccatggtagcatcctcagca

SEQ ID NO: 20113 - DNA, 32 bp, Homo sapiens
atttgccttctctgagcttcagtttccttcta

SEQ ID NO: 20114 - DNA, 32 bp, Homo sapiens
atttccactcaacatcaagataagctgctcta

SEQ ID NO: 20115 - DNA, 32 bp, Homo sapiens
tcactgtctcctaggctggagtgcagtggtgt

SEQ ID NO: 20116 - DNA, 32 bp, Homo sapiens
cacttctgcccaggcagcagggtgggtgggta

SEQ ID NO: 20117 - DNA, 32 bp, Homo sapiens
cgtgtcgatgtgtggcttatcctgcaggagtg

SEQ ID NO: 20118 - DNA, 32 bp, Homo sapiens
tctgcttcctatagctgggatgatatggggga

SEQ ID NO: 20119 - DNA, 32 bp, Homo sapiens
agctgaatgagtctgctttcactgtgactggg

SEQ ID NO: 20120 - DNA, 32 bp, Homo sapiens
gctctgttgcccagctggagtgcagtggtgtg

SEQ ID NO: 20121 - DNA, 32 bp, Homo sapiens
attgcctttggcaattcttcttctcaagcact

SEQ ID NO: 20122 - DNA, 32 bp, Homo sapiens
ggctcatgcttgtaatcccagcactttgggaa

SEQ ID NO: 20123 - DNA, 32 bp, Homo sapiens
agtcttaggcctggtggctgatcacttgtggg

SEQ ID NO: 20124 - DNA, 32 bp, Homo sapiens
gccccctgttcctgggtttatgcagttttctt

SEQ ID NO: 20125 - DNA, 32 bp, Homo sapiens
ctggagccgagtttcgctctgctgcccaggct

SEQ ID NO: 20126 - DNA, 26 bp, Homo sapiens
tctgcataatgttcactgccaaactc

SEQ ID NO: 20127 - DNA, 32 bp, Homo sapiens
aactccaaatggagaagtagtcactgtagact

SEQ ID NO: 20128 - DNA, 32 bp, Homo sapiens
cactgcatggcctcctgtcactgtgaatcgtg

SEQ ID NO: 20129 - DNA, 20 bp, Homo sapiens
cggggcggggggaagcgctc

SEQ ID NO: 20130 - DNA, 32 bp, Homo sapiens
ttgagatggagtttcactctgtctcccaggct

SEQ ID NO: 20131 - DNA, 32 bp, Homo sapiens
aagtgtagaagagggagagagaagcaggagag

SEQ ID NO: 20132 - DNA, 32 bp, Homo sapiens
tacgtgggataggatttattctctccacactt

SEQ ID NO: 20133 - DNA, 32 bp, Homo sapiens
gtgattaagccttcagttatcctaattccctt

SEQ ID NO: 20134 - DNA, 32 bp, Homo sapiens
tgaaagaagaatttgtggaagttaatttgtaa

SEQ ID NO: 20135 - DNA, 32 bp, Homo sapiens
ctccattgcccaggctggagtacaatggtgcg

SEQ ID NO: 20136 - DNA, 32 bp, Homo sapiens
ggggtgctcctggcctggagtgggtggaggcc

SEQ ID NO: 20137 - DNA, 32 bp, Homo sapiens
aaggttccaagagtgaggagagaatgcatggg

SEQ ID NO: 20138 - DNA, 32 bp, Homo sapiens
ctactcgggaggctgaggcaggaaaattgctt

SEQ ID NO: 20139 - DNA, 32 bp, Homo sapiens
gtctcaaactcctggcttcaagcaatccttcc

SEQ ID NO: 20140 - DNA, 31 bp, Homo sapiens
gcataaataataaaaagtaggaggggtggag

SEQ ID NO: 20141 - DNA, 21 bp, Homo sapiens
catgtgtaatcccagcatttt

SEQ ID NO: 20142 - DNA, 32 bp, Homo sapiens
acgtgattgaccttggcgagatcatgtttcta

SEQ ID NO: 20143 - DNA, 32 bp, Homo sapiens
actctgttgcccaagctggggtgcagtggcac

SEQ ID NO: 20144 - DNA, 21 bp, Homo sapiens
cgcccagccccggcccctgga

SEQ ID NO: 20145 - DNA, 32 bp, Homo sapiens
agctcctttcttctcccacatctgcccactga

SEQ ID NO: 20146 - DNA, 32 bp, Homo sapiens
ctctccaagctcaattctctaagcccctcagg

SEQ ID NO: 20147 - DNA, 32 bp, Homo sapiens
ggagctgggcctgggaacagccctggcttggt

SEQ ID NO: 20148 - DNA, 32 bp, Homo sapiens
atacataaagagacagtaggacattgtggctg

SEQ ID NO: 20149 - DNA, 32 bp, Homo sapiens
aagtaacaaagtgatggcttggaacactgtct

SEQ ID NO: 20150 - DNA, 32 bp, Homo sapiens
atccagaccctcccttcttgctggggagggga

SEQ ID NO: 20151 - DNA, 23 bp, Homo sapiens
ctgtcatcaggctggagtgcagt

SEQ ID NO: 20152 - DNA, 19 bp, Homo sapiens
ggcccagctcctcctgcct

SEQ ID NO: 20153 - DNA, 32 bp, Homo sapiens
tttttgaggagtttcgctcttgttggctaggc

SEQ ID NO: 20154 - DNA, 21 bp, Homo sapiens
tggagcgatctcggctcactg

SEQ ID NO: 20155 - DNA, 32 bp, Homo sapiens
agacatcatcccttgtataccatcgtagactt

SEQ ID NO: 20156 - DNA, 32 bp, Homo sapiens
gctctctcgcccaggctggagtgcagtggtgc

SEQ ID NO: 20157 - DNA, 32 bp, Homo sapiens
gctctttcgcccaggctggagtgcagtggcgc

SEQ ID NO: 20158 - DNA, 32 bp, Homo sapiens
ttccctctgcccaggtgggggccgtggctgga

SEQ ID NO: 20159 - DNA, 32 bp, Homo sapiens
ttgaggtcaagcaaccctcccacctcggcctg

SEQ ID NO: 20160 - DNA, 32 bp, Homo sapiens
ggcaggtgcctgtaatcccagcactttgggaa

SEQ ID NO: 20161 - DNA, 32 bp, Homo sapiens
gctctgtcgcccatgctggagtgcagtggcgc

SEQ ID NO: 20162 - DNA, 32 bp, Homo sapiens
aaacttgaagtccaagccgtgctgctgattcc

SEQ ID NO: 20163 - DNA, 32 bp, Homo sapiens
acctcctcctcccgggttcaagcaattctccc

SEQ ID NO: 20164 - DNA, 32 bp, Homo sapiens
gttgtcccaagtggacataattataaatagct

SEQ ID NO: 20165 - DNA, 32 bp, Homo sapiens
ttccttcataaaacatgtaacactgatcttca

SEQ ID NO: 20166 - DNA, 18 bp, Homo sapiens
gtggggaaagagatgggg

SEQ ID NO: 20167 - DNA, 32 bp, Homo sapiens
ccaggctttatctgtcaggtggcaattctcac

SEQ ID NO: 20168 - DNA, 32 bp, Homo sapiens
taattaatggacaactgtagtgcagtgatcct

SEQ ID NO: 20169 - DNA, 32 bp, Homo sapiens
gaggagaatcagcttagagaactatcaacaca

SEQ ID NO: 20170 - DNA, 32 bp, Homo sapiens
ttgccccatccctcccacacacaggaccagac

SEQ ID NO: 20171 - DNA, 32 bp, Homo sapiens
ctcaatgcctccattccaaactgttgtctgct

SEQ ID NO: 20172 - DNA, 32 bp, Homo sapiens
tgctctgtcaccaggctggagggcagtggcgc

SEQ ID NO: 20173 - DNA, 32 bp, Homo sapiens
attccctgtgacctagttggtgcagtggcttg

SEQ ID NO: 20174 - DNA, 32 bp, Homo sapiens
ccggccggtagtccctggcgctgctgacccag

SEQ ID NO: 20175 - DNA, 32 bp, Homo sapiens
cagctcctgagtagctgggattacaggcgccc

SEQ ID NO: 20176 - DNA, 21 bp, Homo sapiens
agcaaaggctgctggtgtcag

SEQ ID NO: 20177 - DNA, 32 bp, Homo sapiens
aaatacatttcctgggtaacttaggaaattaa

SEQ ID NO: 20178 - DNA, 32 bp, Homo sapiens
gcctccgcctcccgggttcaagcaattctcat

SEQ ID NO: 20179 - DNA, 32 bp, Homo sapiens
aacttgggccatcctatcatctggagccctag

SEQ ID NO: 20180 - DNA, 32 bp, Homo sapiens
tttattgcttcttctcccatctgcccgttgac

SEQ ID NO: 20181 - DNA, 32 bp, Homo sapiens
aacctagggaggcagaggttgtagtgagccaa

SEQ ID NO: 20182 - DNA, 19 bp, Homo sapiens
caggctcttcttccagcct

SEQ ID NO: 20183 - DNA, 32 bp, Homo sapiens
ccctttgtaatgctgctcctctccactgccca

SEQ ID NO: 20184 - DNA, 32 bp, Homo sapiens
gagaagctcactctgtgttaggcacagtggtg

SEQ ID NO: 20185 - DNA, 32 bp, Homo sapiens
cctaggaggcccaggctggagtgaggtggcac

SEQ ID NO: 20186 - DNA, 32 bp, Homo sapiens
actctgtcacccaggctggagtgcaatggtgc

SEQ ID NO: 20187 - DNA, 32 bp, Homo sapiens
ttttggtcatgggctggtctggtcggtttccc

SEQ ID NO: 20188 - DNA, 32 bp, Homo sapiens
gtcagagttttctaccaactggcatctgtgat

SEQ ID NO: 20189 - DNA, 32 bp, Homo sapiens
gctctgttgcccaggctggagtgtaatggtgc

SEQ ID NO: 20190 - DNA, 87 bp, Homo sapiens
cccgtgaggaacagtggcgggattgtcccagggccccttccagcagggggacctcctgacttgagagtccccaaagccttcccaggg

SEQ ID NO: 20191 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 20192 - DNA, 60 bp, Homo sapiens; identical to SEQ ID NO: 147

SEQ ID NO: 20193 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 20194 - DNA, 88 bp, Homo sapiens
ctctaacaaggtgcaggagcttagctgattggtgaacagtgattggtttccgctttgttcacagtggctaagttctgcacctgaagag

SEQ ID NO: 20195 - DNA, 81 bp, Homo sapiens
tggggacagttaagttggagccgctggggcagaggccgttgctgacgggccggccgctgctgcacagtcagcttgggtgcg

SEQ ID NO: 20196 - DNA, 80 bp, Homo sapiens
ggtcaaatgtattgaaagttgcaaaaattcttcttacaaacataaagtgtgctgaatccactacgtaaaccaaaatcaaa

SEQ ID NO: 20197 - DNA, 82 bp, Homo sapiens
ggctgtgagcggggcggggcggggctttcggaggagctcctgttgttctgggcgcggtgaactctctcttgtatttgcagtc

SEQ ID NO: 20198 - DNA, 68 bp, Homo sapiens
ctccggtgcctactgagctgatatcagttctcattttacacactggctcagttcagcaggaacaggag

SEQ ID NO: 20199 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 20200 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 20201 - DNA, 15 bp, Homo sapiens
tttaaccgcattctc

SEQ ID NO: 20202 - DNA, 20 bp, Homo sapiens
tactaatacgactcactaaa

SEQ ID NO: 20203 - DNA, 30 bp, Homo sapiens
gactagctggaattcaaggatgcggttaaa

SEQ ID NO: 20204 - DNA, 30 bp, Homo sapiens
cagccaacgctgcagatacgactcactaaa

SEQ ID NO: 20205 - DNA, 50 bp, Homo sapiens
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 20206 - DNA, 20 bp, Homo sapiens
ggaattcaaggatgcggtta

SEQ ID NO: 20207 - DNA, 10 bp, Homo sapiens
  misc_feature (3)..(4): n is a, c, g or t
  misc_feature (8)..(9): n is a, c, g or t
ggnngggnng

SEQ ID NO: 20208 - DNA, 12 bp, Homo sapiens
tttaaccgcatc

SEQ ID NO: 20209 - DNA, 12 bp, Homo sapiens
cgactcactaaa

SEQ ID NO: 20210 - DNA, 40 bp, Homo sapiens
taatacgactcactataggcccttattagaggattctgct

SEQ ID NO: 20211 - DNA, 41 bp, Homo sapiens
aattaaccctcactaaaggtttttttttcctgagacagagt

SEQ ID NO: 20212 - DNA, 42 bp, Homo sapiens
taatacgactcactatagggtgaggtagtaagttgtattgtt

SEQ ID NO: 20213 - DNA, 41 bp, Homo sapiens
aattaaccctcactaaagggaaagtagtaagttgtatagtt

SEQ ID NO: 20214 - DNA, 20 bp, Homo sapiens
gaggcaggagaattgcttga

SEQ ID NO: 20215 - DNA, 39 bp, Homo sapiens
aattaaccctcactaaaggcctgagacagagtcttgctc

SEQ ID NO: 20216 - DNA, 82 bp, Homo sapiens
ctctaacaaggtgcaggagcttagctgattggtgaacagtgattggtttccgctttgttcacagtggctaagttctgcacct
